US011965166B2

(12) United States Patent
McIninch et al.

(10) Patent No.: US 11,965,166 B2
(45) Date of Patent: Apr. 23, 2024

(54) COMPLEMENT FACTOR B (CFB) iRNA COMPOSITIONS AND METHODS OF USE THEREOF

(71) Applicant: Alnylam Pharmaceuticals, Inc., Cambridge, MA (US)

(72) Inventors: James D. McIninch, Burlington, MA (US); Mark K. Schlegel, Boston, MA (US); Adam Castoreno, Framingham, MA (US); Elane Fishilevich, Rochester, MA (US); Kristina Yucius, Burlington, MA (US)

(73) Assignee: Alnylam Pharmaceuticals, Inc., Cambridge, MA (US)

( * ) Notice: Subject to any disclaimer, the term of this patent is extended or adjusted under 35 U.S.C. 154(b) by 0 days.

(21) Appl. No.: 18/187,741

(22) Filed: Mar. 22, 2023

(65) Prior Publication Data

US 2023/0257749 A1  Aug. 17, 2023

Related U.S. Application Data

(63) Continuation of application No. PCT/US2022/047987, filed on Oct. 27, 2022.

(60) Provisional application No. 63/273,215, filed on Oct. 29, 2021.

(51) Int. Cl.
*C07H 21/04* (2006.01)
*A61P 43/00* (2006.01)
*C12N 15/113* (2010.01)

(52) U.S. Cl.
CPC .......... *C12N 15/113* (2013.01); *A61P 43/00* (2018.01); *C12N 2310/11* (2013.01)

(58) Field of Classification Search
None
See application file for complete search history.

(56) References Cited

U.S. PATENT DOCUMENTS

| | | | |
|---|---|---|---|
| 10,465,194 B2 * | 11/2019 | Borodovsky | ........... A61P 29/00 |
| 11,186,842 B2 | 11/2021 | Borodovsky et al. | |
| 2003/0096775 A1 | 5/2003 | Graham et al. | |
| 2007/0088154 A1 | 4/2007 | Khvorova et al. | |
| 2007/0123484 A1 | 5/2007 | Bhat | |
| 2008/0113351 A1 | 5/2008 | Naito et al. | |
| 2009/0239814 A1 | 9/2009 | Manoharan et al. | |
| 2009/0306178 A1 | 12/2009 | Bhat et al. | |
| 2013/0217756 A1 | 8/2013 | Cancilla et al. | |
| 2013/0281511 A1 | 10/2013 | Bettencourt et al. | |
| 2016/0222389 A1 | 8/2016 | Grossman | |
| 2017/0159055 A1 | 6/2017 | Prakash et al. | |
| 2020/0263183 A1 | 8/2020 | Borodovsky et al. | |
| 2020/0339998 A1 | 10/2020 | Borodovsky et al. | |

FOREIGN PATENT DOCUMENTS

| | | |
|---|---|---|
| EP | 1752536 A1 | 2/2007 |
| WO | WO-2003/066805 A2 | 8/2003 |
| WO | WO-2006/047673 A2 | 5/2006 |
| WO | WO-2007/064846 A2 | 6/2007 |
| WO | WO-2007/089375 A2 | 8/2007 |
| WO | WO-2008/036841 A2 | 3/2008 |
| WO | WO-2010/048352 A2 | 4/2010 |
| WO | WO-2012/037254 A1 | 3/2012 |
| WO | WO-2013/067076 A2 | 5/2013 |
| WO | WO-2013/074974 A2 | 5/2013 |
| WO | WO-2014/107763 A1 | 7/2014 |
| WO | WO-2015/038939 A2 | 3/2015 |
| WO | WO-2015/089368 A2 | 6/2015 |
| WO | WO-2017/040078 A1 | 3/2017 |
| WO | WO-2019/027015 A1 | 2/2019 |
| WO | WO-2019/089922 A1 | 5/2019 |
| WO | WO-2021/081026 A1 | 4/2021 |
| WO | WO-2021/178607 A1 | 9/2021 |
| WO | WO-2021/222549 A1 | 11/2021 |

OTHER PUBLICATIONS

Bora et al., Complement activation via alternative pathway is critical in the development of laser-induced choroidal neovascularization: role of factor B and factor H. J Immunol. Aug. 1, 2006;177(3):1872-8.
Borodovsky et al., Development of RNAi Therapeutics Targeting the Complement Pathway. Blood. 2013;122(21)2471.
Cheng et al., [Effect of C5-siRNA silencing receptor C5 on myocardial ischemia injury in rats]. Nan Fang Yi Ke Da Xue Xue Bao. Jun. 2010;30(6):1486-8.
International Search Report and Written Opinion for Application No. PCT/US2014/069951, dated Jul. 6, 2015.
Zheng et al., "Preventing Renal Ischemia-Reperfusion Injury Using Small Interfering RNA by Targeting Complement 3 Gene," American Journal of Transplantation 2006; 6: 2099-2108.
Zheng et al., "Protection of Renal Ischemia Injury using Combination Gene Silencing of Complement 3 and Caspase 3 Genes," *Transplantation* 2006;82: 1781-1786.
Reynolds et al., "Rational siRNA design for RNA interference," Nature Biotechnology, vol. 22, pp. 326-330, 2004.
International Search Report and Written Opinion from PCT/US2018/058705, dated Mar. 1, 2019.
International Search Report and Written Opinion from PCT/US2020/056563, dated Mar. 22, 2021.
International Search Report and Written Opinion from PCT/US2021/020777, dated Aug. 16, 2021.
Vickers et al., "Efficient Reduction of Target RNAs by Small Interfering RNA and RNase H-dependent Antisense Agents", The Journal of Biological Chemistry, 2003, 278:7108-7118).

(Continued)

*Primary Examiner* — Kimberly Chong
(74) *Attorney, Agent, or Firm* — McCarter & English, LLP; Maria Laccotripe Zacharakis; Deborah L. Nagle

(57) ABSTRACT

The present invention relates to RNAi agents, e.g., dsRNA agents, targeting the complement factor B (CFB) gene. The invention also relates to methods of using such RNAi agents to inhibit expression of a CFB gene and to methods of treating or preventing a CFB-associated disease in a subject.

30 Claims, 2 Drawing Sheets

Specification includes a Sequence Listing.

(56) References Cited

OTHER PUBLICATIONS

Watts et al., "Gene silencing by siRNAs and antisense oligonucleotides in the laboratory and the clinic", J Pathol 2012; 226: 365-379.
U.S. Appl. No. 15/176,231 U.S. Pat. No. 10,465,194, filed Jun. 8, 2016 Nov. 5, 2019, US 20160298124, Granted.
U.S. Appl. No. 16/574,158 U.S. Pat. No. 11,186,842, filed Sep. 18, 2019 Nov. 30, 2021, US 20200263183, Granted.
U.S. Appl. No. 16/925,463, filed Jul. 10, 2020, US 20200339998, Abandoned.
U.S. Appl. No. 17/405,199, filed Aug. 18, 2021, US 20220213486, Published.
PCT/US2014/069951, Dec. 12, 2014, WO 2015/089368, Completed.
PCT/US2021/029872, Apr. 29, 2021, WO 2021/222549, Completed.

\* cited by examiner

COMPLEMENT FACTOR B (CFB) iRNA COMPOSITIONS AND METHODS OF USE THEREOF

RELATED APPLICATION

This application is a 35 § U.S.C. 111(a) continuation application which claims the benefit of priority to PCT/US2022/047987, filed on Oct. 27, 2022, which, in turn, claims the benefit of priority to U.S. Provisional Application No. 63/273,215, filed on Oct. 29, 2021. The entire contents of each of the foregoing applications are incorporated herein by reference.

SEQUENCE LISTING

The instant application contains a Sequence Listing which has been submitted electronically in XML file format and is hereby incorporated by reference in its entirety. Said XML copy, created on Mar. 21, 2023, is named 121301-18902_SL.xml and is 20,880,720 bytes in size.

BACKGROUND OF THE INVENTION

Complement was first discovered in the 1890s when it was found to aid or "complement" the killing of bacteria by heat-stable antibodies present in normal serum (Walport, M. J. (2001) *N Engl J Med.* 344:1058). The complement system consists of more than 30 proteins that are either present as soluble proteins in the blood or are present as membrane-associated proteins. Activation of complement leads to a sequential cascade of enzymatic reactions, known as complement activation pathways resulting in the formation of the potent anaphylatoxins C3a and C5a that elicit a plethora of physiological responses that range from chemoattraction to apoptosis. Initially, complement was thought to play a major role in innate immunity where a robust and rapid response is mounted against invading pathogens. However, recently it is becoming increasingly evident that complement also plays an important role in adaptive immunity involving T and B cells that help in elimination of pathogens (Dunkelberger J R and Song W C. (2010) *Cell Res.* 20:34; Molina H, et al. (1996) *Proc Natl Acad Sci USA.* 93:3357), in maintaining immunologic memory preventing pathogenic re-invasion, and is involved in numerous human pathological states (Qu, H, et al. (2009) *Mol Immunol.* 47:185; Wagner, E. and Frank M M. (2010) *Nat Rev Drug Discov.* 9:43).

Complement activation is known to occur through three different pathways: alternate, classical and lectin (FIG. 1) involving proteins that mostly exist as inactive zymogens that are then sequentially cleaved and activated.

The classical pathway is often activated by antibody-antigen complexes or by the C-reactive protein (CRP), both of which interact with complement component C1q. In addition, the classical pathway can be activated by phosphatidyl serine present in apoptotic bodies in the absence of immune complexes.

The lectin pathway is initiated by the mannose-binding lectins (MBL) that bind to complex carbohydrate residues on the surface of pathogens. The activation of the classical pathway or the lectin pathway leads to activation of the (C4b2b) C3 convertase.

The alternate pathway is activated by the binding of C3b, which is spontaneously generated by the hydrolysis of C3, on targeted surfaces. This surface-bound C3b is then recognized by factor B, forming the complex C3bB. The C3bB complex, in turn, is cleaved by factor D to yield the active form of the C3 convertase of the AP (C3bBb). Both types of C3 convertases will cleave C3, forming C3b. C3b then either binds to more factor B, enhancing the complement activation through the AP (the so-called alternative or amplification loop), or leads to the formation of the active C5 convertase (C3bBbC3b or C4bC2bC3b), which cleaves C5 and triggers the late events that result in the formation of the membrane attack complex (MAC) (C5b-9).

Inappropriate activation of the complement system is responsible for propagating or initiating pathology in many different diseases, including, for example, C3 glomerulopathy, systemic lupus erythematosus (SLE), e.g., Lupus Nephritis, IgA nephropathy, diabetic nephropathy, polycystic kidney disease, membranous nephropathy, age-related macular degeneration, atypical hemolytic uremic syndrome, thrombotic microangiopathy, myasthenia gravis, ischemia and reperfusion injury, paroxysmal nocturnal hemoglobinuria, and rheumatoid arthritis.

To date, only one therapeutic that targets the alternate pathway, e.g., the C5-C5a axis, is available for the treatment of complement component-associated diseases, the anti-C5 antibody, eculizumab (Soliris®). Although eculizumab has been shown to be effective for the treatment of paroxysmal nocturnal hemoglobinuria (PNH), atypical hemolytic uremic syndrome (aHUS), and Myasthenia Gravis, and is currently being evaluated in clinical trials for additional complement component-associated diseases, eculizumab therapy requires weekly high dose infusions followed by biweekly maintenance infusions at a high cost. Furthermore, approximately 50% of eculizumab-treated PNH subjects have low level of hemolysis and require residual transfusions (Hill A, et al. (2010) *Haematologica* 95(4):567-73).

Accordingly, there is a need in the art for compositions and methods for treating diseases, disorders, and conditions associated with complement activation by, for example, activation of complement factor B activity.

SUMMARY OF THE INVENTION

The present invention provides iRNA compositions which affect the RNA-induced silencing complex (RISC)-mediated cleavage of RNA transcripts of a gene encoding complement factor B (CFB). The complement factor B (CFB) may be within a cell, e.g., a cell within a subject, such as a human subject.

Accordingly, in one aspect, the invention provides a double stranded ribonucleic acid (dsRNA) agent for inhibiting expression of complement factor B (CFB) in a cell, wherein the dsRNA agent comprises a sense strand and an antisense strand forming a double stranded region, wherein the sense strand comprises at least 15, e.g., 15, 16, 17, 18, 19, 20, or 21, contiguous nucleotides differing by no more than 0, 1, 2, or 3 nucleotides from the nucleotide sequence of SEQ ID NO:1 and the antisense strand comprises at least 15, e.g., 15, 16, 17, 18, 19, 20, 21, 22, or 23, contiguous nucleotides differing by no more than 1, 2, or 3 nucleotides from the corresponding portion of the nucleotide sequence of SEQ ID NO:8.

In another aspect, the present invention provides a double stranded ribonucleic acid (dsRNA) for inhibiting expression of complement factor B (CFB) in a cell, wherein said dsRNA comprises a sense strand and an antisense strand forming a double stranded region, wherein the antisense strand comprises a region of complementarity to an mRNA encoding complement factor B (CFB), and wherein the region of complementarity comprises at least 15, e.g., 15, 16, 17, 18, 19, 20, 21, 22, or 23, contiguous nucleotides differing by no more than 0, 1, 2, or 3 nucleotides from any one of the antisense nucleotide sequences in any one of Tables 2-3.

In one embodiment, the dsRNA agent comprises a sense strand comprising any of the sense nucleotide sequences in any one of Tables 2-3.

In one embodiment, the dsRNA agent comprises an antisense strand comprising any of the antisense nucleotide sequences in any one of Tables 2-3.

In one embodiment, the dsRNA agent comprises a sense strand comprising any of the sense nucleotide sequences in any one of Tables 2-3 and an antisense strand comprising any of the antisense nucleotide sequences in any one of Tables 2-3.

In one embodiment, the dsRNA agent comprises a sense strand comprising a nucleotide sequence which differs by no more than 4 nucleotides from any of the sense nucleotide sequences in any one of Tables 2-3 and an antisense strand comprising a nucleotide sequence which differs by no more than 4 nucleotides from any of the antisense nucleotide sequences in any one of Tables 2-3.

In one embodiment, the dsRNA agent comprises a sense strand comprising a nucleotide sequence which differs by no more than 3 nucleotides from any of the sense nucleotide sequences in any one of Tables 2-3 and an antisense strand comprising a nucleotide sequence which differs by no more than 3 nucleotides from any of the antisense nucleotide sequences in any one of Tables 2-3.

In one embodiment, the dsRNA agent comprises a sense strand comprising a nucleotide sequence which differs by no more than 2 nucleotides from any of the sense nucleotide sequences in any one of Tables 2-3 and an antisense strand comprising a nucleotide sequence which differs by no more than 2 nucleotides from any of the antisense nucleotide sequences in any one of Tables 2-3.

In one embodiment, the dsRNA agent comprises a sense strand comprising a nucleotide sequence which differs by no more than 1 nucleotide from any of the sense nucleotide sequences in any one of Tables 2-3 and an antisense strand comprising a nucleotide sequence which differs by no more than 1 nucleotide from any of the antisense nucleotide sequences in any one of Tables 2-3.

In another aspect, the present invention provides a double stranded ribonucleic acid (dsRNA) for inhibiting expression of complement factor B (CFB) in a cell, wherein said dsRNA comprises a sense strand and an antisense strand forming a double stranded region, wherein the sense strand comprises at least 15, e.g., 15, 16, 17, 18, 19, 20, or 21, contiguous nucleotides differing by no more than 0, 1, 2, 3 or 4 nucleotides from any one of the nucleotide sequence of nucleotides 504-526, 640-662, 641-663, 995-1017, 997-1019, 1034-1056, 1141-1163, 1145-1167, 1389-1411, 1473-1495, 1826-1848, 1828-1850, 1842-1864, 2242-2264, 2391-2413, 2393-2415, 2438-2460, or 2453-2475 of SEQ ID NO: 1, and the antisense strand comprises at least 15, e.g., 15, 16, 17, 18, 19, 20, 21, 22 or 23, contiguous nucleotides from the corresponding nucleotide sequence of SEQ ID NO:8.

In one embodiment, the antisense strand comprises at least 15, e.g., 15, 16, 17, 18, 19, 20, 21, 22, or 23, contiguous nucleotides differing by no more than 0, 1, 2, 3, or 4 nucleotides from any one of the antisense strand nucleotide sequences of a duplex selected from the group consisting of AD-1726057; AD-1725763; AD-1725777; AD-1725057; AD-1725096; AD-1728786; AD-1725059; AD-1728276; AD-1728278; AD-1726936; AD-1725472; AD-1724715; AD-1727292; AD-1730477; AD-1727288; AD-1730167; AD-1725408; and AD-1725761.

In one embodiment, the sense strand and the antisense strand comprise at least 15, e.g., 15, 16, 17, 18, 19, 20, 21, 22, or 23, contiguous nucleotides differing by no more than 0, 1, 2, 3, or 4 nucleotides from any one of the sense strand and the antisense strand nucleotide sequences of a duplex selected from the group consisting of AD-1726057; AD-1725763; AD-1725777; AD-1725057; AD-1725096; AD-1728786; AD-1725059; AD-1728276; AD-1728278; AD-1726936; AD-1725472; AD-1724715; AD-1727292; AD-1730477; AD-1727288; AD-1730167; AD-1725408; and AD-1725761.

In one embodiment, the sense strand and the antisense strand comprise the sense strand and the antisense strand nucleotide sequences of a duplex selected from the group consisting of AD-1726057; AD-1725763; AD-1725777; AD-1725057; AD-1725096; AD-1728786; AD-1725059; AD-1728276; AD-1728278; AD-1726936; AD-1725472; AD-1724715; AD-1727292; AD-1730477; AD-1727288; AD-1730167; AD-1725408; and AD-1725761.

In one embodiment, the sense strand and the antisense strand consist of the sense strand and the antisense strand nucleotide sequences of a duplex selected from the group consisting of AD-1726057; AD-1725763; AD-1725777; AD-1725057; AD-1725096; AD-1728786; AD-1725059; AD-1728276; AD-1728278; AD-1726936; AD-1725472; AD-1724715; AD-1727292; AD-1730477; AD-1727288; AD-1730167; AD-1725408; and AD-1725761.

In one embodiment, the dsRNA agent comprises at least one modified nucleotide.

In one embodiment, substantially all of the nucleotides of the sense strand; substantially all of the nucleotides of the antisense strand comprise a modification; or substantially all of the nucleotides of the sense strand and substantially all of the nucleotides of the antisense strand comprise a modification.

In one embodiment, all of the nucleotides of the sense strand comprise a modification; all of the nucleotides of the antisense strand comprise a modification; or all of the nucleotides of the sense strand and all of the nucleotides of the antisense strand comprise a modification.

In one embodiment, at least one of the modified nucleotides is selected from the group consisting of a deoxynucleotide, a 3'-terminal deoxythimidine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, a nucleotide comprising a 5'-phosphate mimic, a nucleotide comprising a 2'-phosphate group, e.g., cytidine-2'-phosphate (C2p); guanosine-2'-phosphate (G2p); uridine-2'-phosphate (U2p); adenosine-2'-phosphate (A2p); a thermally destabilizing nucleotide, a glycol modified nucleotide (GNA), and a 2-O—(N-methylacetamide) modified nucleotide; and combinations thereof.

In one embodiment, the modifications on the nucleotides are selected from the group consisting of LNA, HNA, CeNA, 2'-methoxyethyl, 2'-O-alkyl, 2'-O-allyl, 2'-C-allyl, 2'-fluoro, 2'-deoxy, 2'-hydroxyl, and glycol; and combinations thereof.

In one embodiment, at least one of the modified nucleotides is selected from the group consisting of a deoxynucleotide, a 2'-O-methyl modified nucleotide, a 2'-fluoro modified nucleotide, a 2'-deoxy-modified nucleotide, a glycol modified nucleotide (GNA), e.g., Ggn, Cgn, Tgn, or Agn, a nucleotide comprising a 2'-phosphate group, and, a vinylphosphonate nucleotide; and combinations thereof.

In another embodiment, at least one of the modifications on the nucleotides is a thermally destabilizing nucleotide modification.

In one embodiment, the thermally destabilizing nucleotide modification is selected from the group consisting of an abasic modification; a mismatch with the opposing nucleotide in the duplex; and destabilizing sugar modification, a 2'-deoxy modification, an acyclic nucleotide, an unlocked nucleic acid (UNA), and a glycerol nucleic acid (GNA).

The double stranded region may be 19-30 nucleotide pairs in length; 19-25 nucleotide pairs in length; 19-23 nucleotide pairs in length; 23-27 nucleotide pairs in length; or 21-23 nucleotide pairs in length.

In one embodiment, each strand is independently no more than 30 nucleotides in length.

In one embodiment, the sense strand is 21 nucleotides in length and the antisense strand is 23 nucleotides in length.

The region of complementarity may be at least 17 nucleotides in length; 19-23 nucleotides in length; or 19 nucleotides in length.

In one embodiment, at least one strand comprises a 3' overhang of at least 1 nucleotide. In another embodiment, at least one strand comprises a 3' overhang of at least 2 nucleotides.

In one embodiment, the dsRNA agent further comprises a ligand.

In one embodiment, the ligand is conjugated to the 3' end of the sense strand of the dsRNA agent.

In one embodiment, the ligand is an N-acetylgalactosamine (GalNAc) derivative.

In one embodiment, the ligand is one or more GalNAc derivatives attached through a monovalent, bivalent, or trivalent branched linker.

In one embodiment, the ligand is

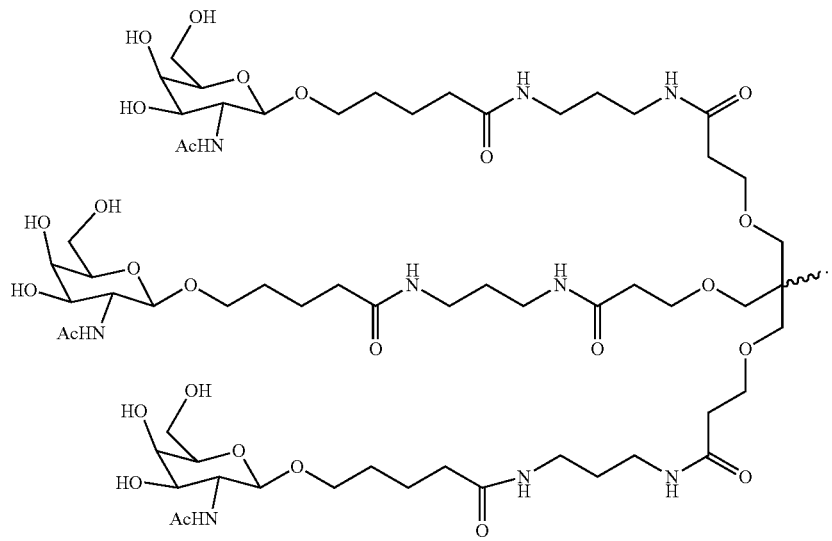 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

In one embodiment, the dsRNA agent is conjugated to the ligand as shown in the following schematic

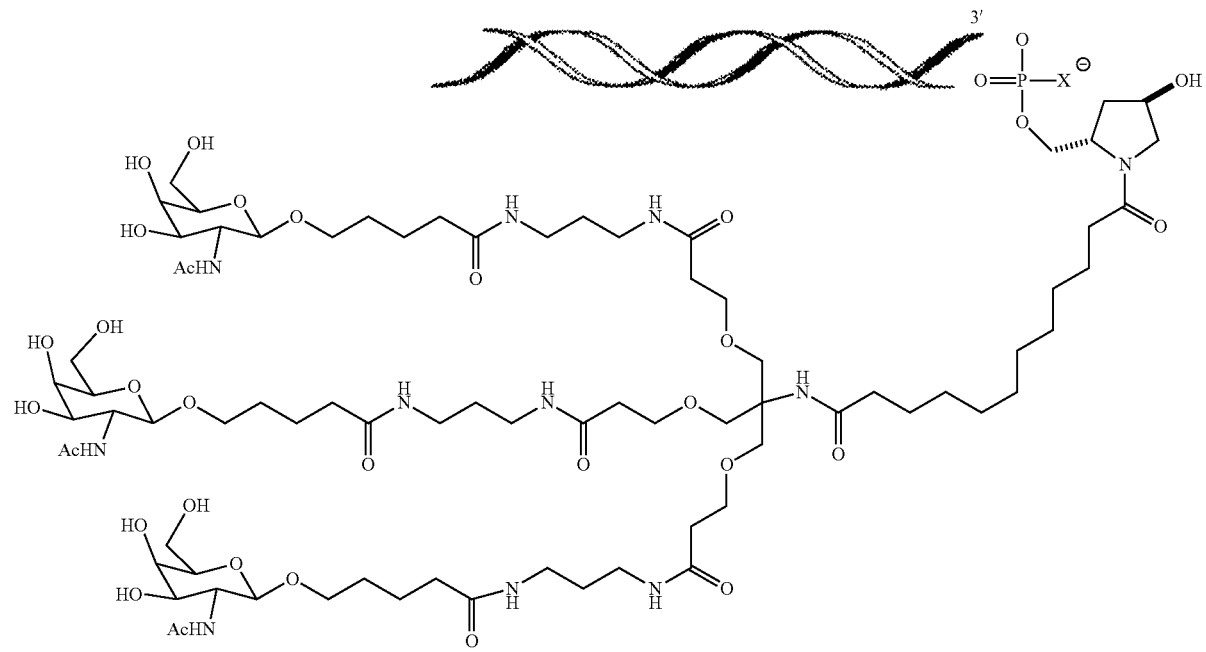

and, wherein X is O or S.

In one embodiment, the X is O.

In one embodiment, the dsRNA agent further comprises at least one phosphorothioate or methylphosphonate internucleotide linkage.

In one embodiment, the phosphorothioate or methylphosphonate internucleotide linkage is at the 3'-terminus of one strand, e.g., the antisense strand or the sense strand.

In another embodiment, the phosphorothioate or methylphosphonate internucleotide linkage is at the 5'-terminus of one strand, e.g., the antisense strand or the sense strand.

In one embodiment, the phosphorothioate or methylphosphonate internucleotide linkage is at the both the 5'- and 3'-terminus of one strand. In one embodiment, the strand is the antisense strand.

In one embodiment, the base pair at the 1 position of the 5'-end of the antisense strand of the duplex is an AU base pair.

The present invention also provides cells containing any of the dsRNA agents of the invention and pharmaceutical compositions comprising any of the dsRNA agents of the invention.

The pharmaceutical composition of the invention may include dsRNA agent in an unbuffered solution, e.g., saline or water, or the pharmaceutical composition of the invention may include the dsRNA agent is in a buffer solution, e.g., a buffer solution comprising acetate, citrate, prolamine, carbonate, or phosphate or any combination thereof; or phosphate buffered saline (PBS).

In one aspect, the present invention provides a method of inhibiting expression of a complement factor B (CFB) gene in a cell. The method includes contacting the cell with any of the dsRNAs of the invention or any of the pharmaceutical compositions of the invention, thereby inhibiting expression of the CFB gene in the cell.

In one embodiment, the cell is within a subject, e.g., a human subject, e.g., a subject having a complement factor B-associated disorder. Such disorders are typically associated with inflammation or immune system activation, e.g., membrane attack complex-mediated lysis, anaphylaxis, or hemolysis. Non-limiting examples of complement factor B-associated disorders include paroxysmal nocturnal hemoglobinuria (PNH), atypical hemolytic uremic syndrome (aHUS), asthma, rheumatoid arthritis (RA); antiphospholipid antibody syndrome; lupus nephritis; ischemia-reperfusion injury; typical or infectious hemolytic uremic syndrome (tHUS); dense deposit disease (DDD); neuromyelitis optica (NMO); multifocal motor neuropathy (MMN); multiple sclerosis (MS); macular degeneration (e.g., age-related macular degeneration (AMD)); hemolysis, elevated liver enzymes, and low platelets (HELLP) syndrome; thrombotic thrombocytopenic purpura (TTP); spontaneous fetal loss; Pauci-immune vasculitis; epidermolysis bullosa; recurrent fetal loss; pre-eclampsia, traumatic brain injury, myasthenia gravis, cold agglutinin disease, dermatomyositis bullous pemphigoid, Shiga toxin *E. coli*-related hemolytic uremic syndrome, C3 neuropathy, anti-neutrophil cytoplasmic antibody-associated vasculitis (e.g., granulomatosis with polyangiitis (previously known as Wegener granulomatosis), Churg-Strauss syndrome, and microscopic polyangiitis), humoral and vascular transplant rejection, graft dysfunction, myocardial infarction (e.g., tissue damage and ischemia in myocardial infarction), an allogenic transplant, sepsis (e.g., poor outcome in sepsis), Coronary artery disease, dermatomyositis, Graves' disease, atherosclerosis, Alzheimer's disease, systemic inflammatory response sepsis, septic shock, spinal cord injury, glomerulonephritis, Hashimoto's thyroiditis, type I diabetes, psoriasis, pemphigus, autoimmune hemolytic anemia (AIHA), ITP, Goodpasture syndrome, Degos disease, antiphospholipid syndrome (APS), catastrophic APS (CAPS), a cardiovascular disorder, myocarditis, a cerebrovascular disorder, a peripheral (e.g., musculoskeletal) vascular disorder, a renovascular disorder, a mesenteric/enteric vascular disorder, vasculitis, Henoch-Schönlein purpura nephritis, systemic lupus erythematosus-associated vasculitis, vasculitis associated with rheumatoid arthritis, immune complex vasculitis, Takayasu's disease, dilated cardiomyopathy, diabetic angiopathy, Kawasaki's disease (arteritis), venous gas embolus (VGE), and restenosis following stent placement, rotational atherectomy, and percutaneous transluminal coronary angioplasty (PTCA) (see, e.g., Holers (2008) *Immunological Reviews* 223:300-316; Holers and Thurman (2004) *Molecular Immunology* 41:147-152; U.S. Patent Publication No. 20070172483).

In one embodiment, the complement factor B-associate disease is selected from the group consisting of C3 glomerulopathy, systemic lupus erythematosus (SLE), e.g., Lupus Nephritis, IgA nephropathy, diabetic nephropathy, polycystic kidney disease, membranous nephropathy, age-related macular degeneration, atypical hemolytic uremic syndrome, thrombotic microangiopathy, myasthenia gravis, ischemia and reperfusion injury, paroxysmal nocturnal hemoglobinuria, and rheumatoid arthritis In another embodiment, the complement factor B-associate disease is selected from the group consisting of C3 glomerulopathy, systemic lupus erythematosus (SLE), e.g., Lupus Nephritis, IgA nephropathy, diabetic nephropathy, and polycystic kidney disease.

In one embodiment, contacting the cell with the dsRNA agent inhibits the expression of CFB by at least 50%, 60%, 70%, 80%, 90%, or 95%.

In one embodiment, inhibiting expression of CFB decreases CFB protein level in serum of the subject by at least 50%, 60%, 70%, 80%, 90%, or 95%.

In one aspect, the present invention provides a method of treating a subject having a disorder that would benefit from reduction in complement factor B (CFB) expression. The method includes administering to the subject a therapeutically effective amount of any of the dsRNAs of the invention or any of the pharmaceutical compositions of the invention, thereby treating the subject having the disorder that would benefit from reduction in CFB expression.

In another aspect, the present invention provides a method of preventing development of a disorder that would benefit from reduction in complement factor B (CFB) expression in a subject having at least one sign or symptom of a disorder who does not yet meet the diagnostic criteria for that disorder. The method includes administering to the subject a prophylactically effective amount of any of the dsRNAs of the invention or any of the pharmaceutical compositions of the invention, thereby preventing the subject progressing to meet the diagnostic criteria of the disorder that would benefit from reduction in CFB expression.

In one embodiment, the disorder is a complement factor B-(CFB)-associated disorder.

In one embodiment, the subject is human.

In one embodiment, the dsRNA agent is administered to the subject at a dose of about 0.01 mg/kg to about 50 mg/kg.

In one embodiment, the dsRNA agent is administered to the subject subcutaneously.

In one embodiment, the level of CFB in the subject sample(s) is a CFB protein level in a blood or serum sample(s).

In one embodiment, the administration of the agent to the subject causes a decrease in hemolysis or a decrease in CFB protein accumulation.

In certain embodiments, the methods of the invention further comprise administering to the subject an additional therapeutic agent.

In some aspects, the additional therapeutic agent is an iRNA agent targeting a C5 gene, such as those described in U.S. Pat. No. 9,249,415, the entire contents of which are hereby incorporated herein by reference.

In other aspects, the additional therapeutic agent is an iRNA agent targeting a complement factor B (CFB) gene, such as those described in U.S. Pat. No. 10,465,194, the entire contents of which are hereby incorporated herein by reference.

In other aspects, the additional therapeutic agent is an inhibitor of C5, such as an anti-complement component C5 antibody, or antigen-binding fragment thereof (e.g., eculizumab, ravulizumab-cwvz, or pozelimab (REGN3918)) or a C5 peptide inhibitor (e.g., zilucoplan). Eculizumab is a humanized monoclonal IgG2/4, kappa light chain antibody that specifically binds complement component C5 with high affinity and inhibits cleavage of C5 to C5a and C5b, thereby inhibiting the generation of the terminal complement complex C5b-9. Eculizumab is described in U.S. Pat. No. 6,355,245, the entire contents of which are incorporated herein by reference. Ravulizumab-cwvz is a humanized IgG2/4 monoclonal antibody that specifically binds complement component C5 with high affinity and inhibits cleavage of C5 to C5a and C5b, thereby inhibiting the generation of the terminal complement complex C5b-9. Ravulizumab-cwvz is described in WO2015134894, the entire contents of which are incorporated herein by reference. Pozelimab (also known as H4H12166P, described in US20170355757, the entire contents of which are incorporated herein by reference) is a fully-human IgG4 monoclonal antibody designed to block complement factor C5. Zilucoplan is a synthetic, macrocyclic peptide that binds complement component 5 (C5) with sub-nanomolar affinity and allosterically inhibits its cleavage into C5a and C5b upon activation of the classical, alternative, or lectin pathways (see, e.g., WO2017105939, the entire contexts of which are incorporated herein by reference).

In yet other aspects, the additional therapeutic is a C3 peptide inhibitor, or analog thereof. In one embodiment, the C3 peptide inhibitor is compstatin. Compstatin is a cyclic tridecapeptide with potent and selective C3 inhibitory activity. Compstatin, and its analogs, are described in U.S. Pat. Nos. 7,888,323, 7,989,589, and 8,442,776, in U.S. Patent Publication No. 2012/0178694 and 2013/0053302, and in PCT Publication Nos. WO 2012/174055, WO 2012/2178083, WO 2013/036778, the entire contents of each of which are incorporated herein by reference.

In certain embodiments, treatments known in the art for the various CFB-associated diseases are used in combination with the RNAi agents of the invention.

The present invention also provides kits comprising any of the dsRNAs of the invention or any of the pharmaceutical compositions of the invention, and optionally, instructions for use.

The present invention further provides an RNA-induced silencing complex (RISC) comprising an antisense strand of any of the dsRNA agents of the invention.

In another embodiment, the RNAi agent is a pharmaceutically acceptable salt thereof. "Pharmaceutically acceptable salts" of each of RNAi agents herein include, but are not limited to, a sodium salt, a calcium salt, a lithium salt, a potassium salt, an ammonium salt, a magnesium salt, an mixtures thereof. One skilled in the art will appreciate that the RNAi agent, when provided as a polycationic salt having one cation per free acid group of the optionally modified phosphodiester backbone and/or any other acidic modifications (e.g., 5'-terminal phosphonate groups). For example, an oligonucleotide of "n" nucleotides in length contains n-1 optionally modified phosphodiesters, so that an oligonucleotide of 21 nt in length may be provided as a salt having up to 20 cations (e.g, 20 sodium cations). Similarly, an RNAi agents having a sense strand of 21 nt in length and an antisense strand of 23 nt in length may be provided as a salt having up to 42 cations (e.g, 42 sodium cations). In the preceding example, where the RNAi agent also includes a 5'-terminal phosphate or a 5'-terminal vinylphosphonate group, the RNAi agent may be provided as a salt having up to 44 cations (e.g, 44 sodium cations).

The present invention is further illustrated by the following detailed description and drawings.

DETAILED DESCRIPTION OF THE INVENTION

Figure 1:
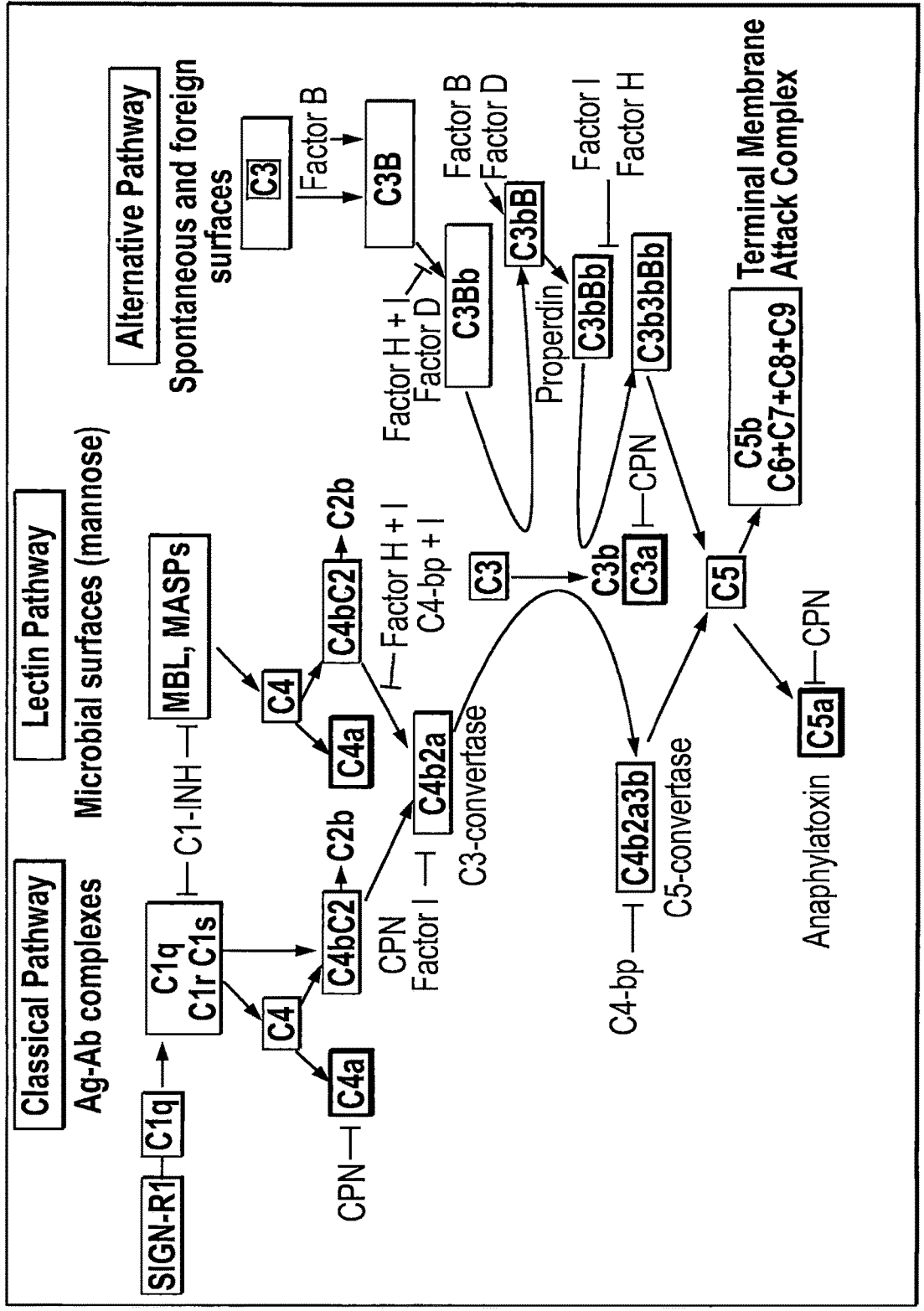
FIG. 1 depicts the three complement pathways: alternative, classical and lectin.

The present invention provides iRNA compositions which effect the RNA-induced silencing complex (RISC)-mediated cleavage of RNA transcripts of a complement factor B (CFB) gene. The gene may be within a cell, e.g., a cell within a subject, such as a human. The use of these iRNAs enables the targeted degradation of mRNAs of the corresponding gene (complement factor B gene) in mammals.

The iRNAs of the invention have been designed to target the human complement factor B gene, including portions of the gene that are conserved in the complement factor B orthologs of other mammalian species. Without intending to be limited by theory, it is believed that a combination or sub-combination of the foregoing properties and the specific target sites or the specific modifications in these iRNAs confer to the iRNAs of the invention improved efficacy, stability, potency, durability, and safety.

Accordingly, the present invention provides methods for treating and preventing a complement factor B-associated disorder, disease, or condition, e.g., a disorder, disease, or condition with inflammation or immune system activation, e.g., membrane attack complex-mediated lysis, anaphylaxis, or hemolysis, e.g., C3 glomerulopathy, systemic lupus erythematosus (SLE), e.g., Lupus Nephritis, IgA nephropathy, diabetic nephropathy, and polycystic kidney disease, using iRNA compositions which effect the RNA-induced silencing complex (RISC)-mediated cleavage of RNA transcripts of a complement factor B gene.

The iRNAs of the invention include an RNA strand (the antisense strand) having a region which is up to about 30 nucleotides or less in length, e.g., 19-30, 19-29, 19-28, 19-27, 19-26, 19-25, 19-24, 19-23, 19-22, 19-21, 19-20, 20-30, 20-29, 20-28, 20-27, 20-26, 20-25, 20-24,20-23, 20-22, 20-21, 21-30, 21-29, 21-28, 21-27, 21-26, 21-25, 21-24, 21-23, or 21-22 nucleotides in length, which region is substantially complementary to at least part of an mRNA transcript of a complement factor B gene. In certain embodiments, the RNAi agents of the disclosure include an RNA strand (the antisense strand) having a region which is about 21-23 nucleotides in length, which region is substantially complementary to at least part of an mRNA transcript of a complement factor B gene.

In certain embodiments, one or both of the strands of the double stranded RNAi agents of the invention is up to 66 nucleotides in length, e.g., 36-66, 26-36, 25-36, 31-60, 22-43, 27-53 nucleotides in length, with a region of at least 19 contiguous nucleotides that is substantially complementary to at least a part of an mRNA transcript of a complement factor B gene. In some embodiments, such iRNA agents having longer length antisense strands may include a second RNA strand (the sense strand) of 20-60 nucleotides in length wherein the sense and antisense strands form a duplex of 18-30 contiguous nucleotides.

The use of iRNAs of the invention enables the targeted degradation of mRNAs of the corresponding gene (complement factor B gene) in mammals. Using in vitro and in vivo assays, the present inventors have demonstrated that iRNAs targeting a complement factor B gene can potently mediate RNAi, resulting in significant inhibition of expression of a complement factor B gene. Thus, methods and compositions including these iRNAs are useful for treating a subject having a complement factor B-associated disorder, e.g., C3 glomerulopathy, systemic lupus erythematosus (SLE), e.g., Lupus Nephritis, IgA nephropathy, diabetic nephropathy, and polycystic kidney disease.

Accordingly, the present invention provides methods and combination therapies for treating a subject having a disorder that would benefit from inhibiting or reducing the expression of a complement factor B gene, e.g., a complement factor B-associated disease, such as C3 glomerulopathy, systemic lupus erythematosus (SLE), e.g., Lupus Nephritis, IgA nephropathy, diabetic nephropathy, and polycystic kidney disease, using iRNA compositions which effect the RNA-induced silencing complex (RISC)-mediated cleavage of RNA transcripts of a CFB gene.

The present invention also provides methods for preventing at least one symptom in a subject having a disorder that would benefit from inhibiting or reducing the expression of a complement factor B gene, e.g., C3 glomerulopathy, systemic lupus erythematosus (SLE), e.g., Lupus Nephritis, IgA nephropathy, diabetic nephropathy, and polycystic kidney disease.

In certain embodiments, the administration of the dsRNA to the subject causes a decrease in CFB mRNA level, CFB protein level, $CH_{50}$ activity (a measure of total hemolytic complement), $AH_{50}$ (a measure the hemolytic activity of the alternate pathway of complement), lactate dehydrogenase (LDH) (a measure of intravascular hemolysis), hemoglobin levels; the level of any one or more of C3, C9, C5, C5a, C5b, and soluble C5b-9 complex.

The following detailed description discloses how to make and use compositions containing iRNAs to inhibit the expression of a complement factor B gene as well as compositions, uses, and methods for treating subjects that would benefit from inhibition or reduction of the expression of a complement factor B gene, e.g., subjects susceptible to or diagnosed with a complement factor B-associated disorder.

I. Definitions

In order that the present invention may be more readily understood, certain terms are first defined. In addition, it should be noted that whenever a value or range of values of a parameter are recited, it is intended that values and ranges intermediate to the recited values are also intended to be part of this invention.

The articles "a" and "an" are used herein to refer to one or to more than one (i.e., to at least one) of the grammatical object of the article. By way of example, "an element" means one element or more than one element, e.g., a plurality of elements.

The term "including" is used herein to mean, and is used interchangeably with, the phrase "including but not limited to".

The term "or" is used herein to mean, and is used interchangeably with, the term "and/or," unless context clearly indicates otherwise. For example, "sense strand or antisense strand" is understood as "sense strand or antisense strand or sense strand and antisense strand."

The term "about" is used herein to mean within the typical ranges of tolerances in the art. For example, "about" can be understood as about 2 standard deviations from the mean. In certain embodiments, about means±10%. In certain embodiments, about means±5%. When about is present before a series of numbers or a range, it is understood that "about" can modify each of the numbers in the series or range.

The term "at least", "no less than" or "or more" prior to a number or series of numbers is understood to include the number adjacent to the term "at least", and all subsequent numbers or integers that could logically be included, as clear from context. For example, the number of nucleotides in a nucleic acid molecule must be an integer. For example, "at least 19 nucleotides of a 21 nucleotide nucleic acid molecule" means that 19, 20, or 21 nucleotides have the indicated property. When at least is present before a series of numbers or a range, it is understood that "at least" can modify each of the numbers in the series or range.

As used herein, "no more than" or "or less" is understood as the value adjacent to the phrase and logical lower values or integers, as logical from context, to zero. For example, a duplex with an overhang of "no more than 2 nucleotides" has a 2, 1, or 0 nucleotide overhang. When "no more than" is present before a series of numbers or a range, it is understood that "no more than" can modify each of the numbers in the series or range. As used herein, ranges include both the upper and lower limit.

As used herein, methods of detection can include determination that the amount of analyte present is below the level of detection of the method.

In the event of a conflict between an indicated target site and the nucleotide sequence for a sense or antisense strand, the indicated sequence takes precedence.

In the event of a conflict between a sequence and its indicated site on a transcript or other sequence, the nucleotide sequence recited in the specification takes precedence.

As used herein, the term "Complement Factor B," used interchangeably with the term "CFB," refers to the well-known gene and polypeptide, also known in the art as AHUS, BF, CFAB, BFD, FB, GBG, FBI12, B-Factor, Properdin, H2-Bf, Glycine-Rich Beta Glycoprotein, C3 Proaccelerator, Properdin Factor 2B, C3 Proactivator, PBF2, Glycine-Rich Beta-Glycoprotein, C3/C5 Convertase, EC 3.4.21, and EC 3.4.21.473.

The term "CFB" includes human CFB, the amino acid and nucleotide sequence of which may be found in, for example, GenBank Accession No. GI:1732746151; mouse CFB, the amino acid and nucleotide sequence of which may be found in, for example, GenBank Accession Nos. GI:218156288 and GI:218156290; rat CFB, the amino acid and nucleotide sequence of which may be found in, for example, GenBank Accession No. GI:218156284; and chimpanzee CFB, the amino acid and nucleotide sequence of which may be found in, for example, GenBank Accession No. GI:57114201. The term "CFB" also includes *Macaca fascicularis* CFB, the amino acid and nucleotide sequence of which may be found in, for example, GenBank Accession No. GI:544428919 and in the entry for the gene, ENSMMUP00000000985 (locus=scaffold3881:47830:53620), in the *Macaca* genome project web site. Additional examples of CFB mRNA sequences are readily available using, e.g., GenBank, UniProt, OMIM, and the *Macaca* genome project web site. Exemplary CFB nucleotide sequences may also be found in SEQ ID NOs:1-7. SEQ ID NOs:8-14 are the antisense sequences of SEQ ID NOs: 1-7, respectively.

The term "CFB," as used herein, also refers to naturally occurring DNA sequence variations of the CFB gene. Non-limiting examples of sequence variations within the CFB gene include 1598A>G in exon 12, which results in a lysine being changed to an arginine at amino acid residue 533; 858C>G in exon 6, which results in a phenylalanine being changed to a leucine at amino acid residue 286; and 967A>G in exon 7, which results in a lysine being changed to an alanine at amino acid residue 323 (Tawadrous H. et al. (2010) *Pediatr Nephrol.* 25:947; Goicoechea de Jorge E et al. (2007) *Proc Natl Acad Sci. USA* 104:240). The term "CFB," as used herein, also refers to single nucleotide polymorphisms in the CFB gene. Numerous sequence variations within the CFB gene have been identified and may be found at, for example, NCBI dbSNP and UniProt (see, e.g., ncbi.nlm.nih.gov/snp).

Further information on CFB can be found, for example, at ncbi.nlm.nih.gov/gene/629.

Additional examples of CFB mRNA sequences are readily available through publicly available databases, e.g., GenBank, UniProt, OMIM, and the *Macaca* genome project web site.

The entire contents of each of the foregoing GenBank Accession numbers and the Gene database numbers are incorporated herein by reference as of the date of filing this application.

As used herein, "target sequence" refers to a contiguous portion of the nucleotide sequence of an mRNA molecule formed during the transcription of a complement factor B gene, including mRNA that is a product of RNA processing of a primary transcription product. The target portion of the sequence will be at least long enough to serve as a substrate for iRNA-directed cleavage at or near that portion of the nucleotide sequence of an mRNA molecule formed during the transcription of a CFB gene. In one embodiment, the target sequence is within the protein coding region of CFB.

The target sequence may be from about 19-36 nucleotides in length, e.g., about 19-30 nucleotides in length. For example, the target sequence can be about 19-30 nucleotides, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. In some embodiments, the target sequence is about 19 to about 30 nucleotides in length. In other embodiments, the target sequence is about 19 to about 25 nucleotides in length. In still other embodiments, the target sequence is about 19 to about 23 nucleotides in length. In some embodiments, the target sequence is about 21 to about 23 nucleotides in length. Ranges and lengths intermediate to the above recited ranges and lengths are also contemplated to be part of the invention.

As used herein, the term "strand comprising a sequence" refers to an oligonucleotide comprising a chain of nucleotides that is described by the sequence referred to using the standard nucleotide nomenclature.

"G," "C," "A," "T," and "U" each generally stand for a nucleotide that contains guanine, cytosine, adenine, thymidine, and uracil as a base, respectively. However, it will be understood that the term "ribonucleotide" or "nucleotide" can also refer to a modified nucleotide, as further detailed below, or a surrogate replacement moiety (see, e.g., Table 1). The skilled person is well aware that guanine, cytosine, adenine, and uracil can be replaced by other moieties without substantially altering the base pairing properties of an oligonucleotide comprising a nucleotide bearing such replacement moiety. For example, without limitation, a nucleotide comprising inosine as its base can base pair with nucleotides containing adenine, cytosine, or uracil. Hence, nucleotides containing uracil, guanine, or adenine can be replaced in the nucleotide sequences of dsRNA featured in the invention by a nucleotide containing, for example, inosine. In another example, adenine and cytosine anywhere in the oligonucleotide can be replaced with guanine and uracil, respectively to form G-U Wobble base pairing with the target mRNA. Sequences containing such replacement moieties are suitable for the compositions and methods featured in the invention.

The terms "iRNA", "RNAi agent," "iRNA agent," "RNA interference agent" as used interchangeably herein, refer to an agent that contains RNA as that term is defined herein, and which mediates the targeted cleavage of an RNA transcript via an RNA-induced silencing complex (RISC) pathway. iRNA directs the sequence-specific degradation of mRNA through a process known as RNA interference (RNAi). The iRNA modulates, e.g., inhibits, the expression of a complement factor B gene in a cell, e.g., a cell within a subject, such as a mammalian subject.

In one embodiment, an RNAi agent of the invention includes a single stranded RNA that interacts with a target RNA sequence, e.g., a complement factor B target mRNA sequence, to direct the cleavage of the target RNA. Without wishing to be bound by theory it is believed that long double stranded RNA introduced into cells is broken down into siRNA by a Type III endonuclease known as Dicer (Sharp et al. (2001) Genes Dev. 15:485). Dicer, a ribonuclease-III-like enzyme, processes the dsRNA into 19-23 base pair short interfering RNAs with characteristic two base 3' overhangs (Bernstein, et al., (2001) Nature 409:363). The siRNAs are then incorporated into an RNA-induced silencing complex (RISC) where one or more helicases unwind the siRNA duplex, enabling the complementary antisense strand to guide target recognition (Nykanen, et al., (2001) Cell 107: 309). Upon binding to the appropriate target mRNA, one or more endonucleases within the RISC cleave the target to induce silencing (Elbashir, et al., (2001) Genes Dev. 15:188). Thus, in one aspect the invention relates to a single stranded RNA (siRNA) generated within a cell and which promotes the formation of a RISC complex to effect silencing of the target gene, i.e., a complement factor B (CFB) gene. Accordingly, the term "siRNA" is also used herein to refer to an iRNA as described above.

In certain embodiments, the RNAi agent may be a single-stranded siRNA (ssRNAi) that is introduced into a cell or organism to inhibit a target mRNA. Single-stranded RNAi agents bind to the RISC endonuclease, Argonaute 2, which then cleaves the target mRNA. The single-stranded siRNAs are generally 15-30 nucleotides and are chemically modified. The design and testing of single-stranded siRNAs are described in U.S. Pat. No. 8,101,348 and in Lima et al., (2012) Cell 150:883-894, the entire contents of each of which are hereby incorporated herein by reference. Any of the antisense nucleotide sequences described herein may be used as a single-stranded siRNA as described herein or as chemically modified by the methods described in Lima et al., (2012) Cell 150:883-894.

In certain embodiments, an "iRNA" for use in the compositions, uses, and methods of the invention is a double stranded RNA and is referred to herein as a "double stranded RNA agent," "double stranded RNA (dsRNA) molecule," "dsRNA agent," or "dsRNA". The term "dsRNA", refers to a complex of ribonucleic acid molecules, having a duplex structure comprising two anti-parallel and substantially complementary nucleic acid strands, referred to as having "sense" and "antisense" orientations with respect to a target RNA, i.e., a complement factor B (CFB) gene. In some embodiments of the invention, a double stranded RNA (dsRNA) triggers the degradation of a target RNA, e.g., an mRNA, through a post-transcriptional gene-silencing mechanism referred to herein as RNA interference or RNAi.

As used herein, the term "modified nucleotide" refers to a nucleotide having, independently, a modified sugar moiety, a modified internucleotide linkage, or modified nucleobase, or any combination thereof. Thus, the term modified nucleotide encompasses substitutions, additions or removal of, e.g., a functional group or atom, to internucleoside linkages, sugar moieties, or nucleobases. The modifications suitable for use in the agents of the invention include all types of modifications disclosed herein or known in the art. Any such modifications, as used in a siRNA type molecule, are encompassed by "iRNA" or "RNAi agent" for the purposes of this specification and claims.

In certain embodiments of the instant disclosure, inclusion of a deoxy-nucleotide—which is acknowledged as a naturally occurring form of nucleotide—if present within a RNAi agent can be considered to constitute a modified nucleotide.

The duplex region may be of any length that permits specific degradation of a desired target RNA through a RISC pathway, and may range from about 19 to 36 base pairs in length, e.g., about 19-30 base pairs in length, for example, about 9, 10, 11, 12, 13, 14, 15, 16, 17, 18, 19, 20, 21, 22, 23, 24, 25, 26, 27, 28, 29, 30, 31, 32, 33, 34, 35, or 36 base pairs in length, such as about 19-30, 19-29, 19-28, 19-27, 19-26, 19-25, 19-24, 19-23, 19-22, 19-21, 19-20, 20-30, 20-29, 20-28, 20-27, 20-26, 20-25, 20-24,20-23, 20-22, 20-21, 21-30, 21-29, 21-28, 21-27, 21-26, 21-25, 21-24, 21-23, or 21-22 base pairs in length. In certain embodiments, the duplex region is 19-21 base pairs in length, e.g., 21 base pairs in length. Ranges and lengths intermediate to the above recited ranges and lengths are also contemplated to be part of the disclosure.

The two strands forming the duplex structure may be different portions of one larger RNA molecule, or they may be separate RNA molecules. Where the two strands are part of one larger molecule, and therefore are connected by an uninterrupted chain of nucleotides between the 3'-end of one strand and the 5'-end of the respective other strand forming the duplex structure, the connecting RNA chain is referred to as a "hairpin loop." A hairpin loop can comprise at least one unpaired nucleotide. In some embodiments, the hairpin loop can comprise at least 4, 5, 6, 7, 8, 9, 10, 20, 23 or more unpaired nucleotides. In some embodiments, the hairpin loop can be 10 or fewer nucleotides. In some embodiments, the hairpin loop can be 8 or fewer unpaired nucleotides. In some embodiments, the hairpin loop can be 4-10 unpaired nucleotides. In some embodiments, the hairpin loop can be 4-8 nucleotides.

In certain embodiment, the two strands of double-stranded oligomeric compound can be linked together. The two strands can be linked to each other at both ends, or at one end only. By linking at one end is meant that 5'-end of first strand is linked to the 3'-end of the second strand or 3'-end of first strand is linked to 5'-end of the second strand. When the two strands are linked to each other at both ends, 5'-end of first strand is linked to 3'-end of second strand and 3'-end of first strand is linked to 5'-end of second strand. The two strands can be linked together by an oligonucleotide linker including, but not limited to, (N)n; wherein N is independently a modified or unmodified nucleotide and n is 3-23. In some embodiments, n is 3-10, e.g., 3, 4, 5, 6, 7, 8, 9, or 10. In some embodiments, the oligonucleotide linker is selected from the group consisting of GNRA, (G)4, (U)4, and (dT)4, wherein N is a modified or unmodified nucleotide and R is a modified or unmodified purine nucleotide. Some of the nucleotides in the linker can be involved in base-pair interactions with other nucleotides in the linker. The two strands can also be linked together by a non-nucleosidic linker, e.g. a linker described herein. It will be appreciated by one of skill in the art that any oligonucleotide chemical modifications or variations describe herein can be used in the oligonucleotide linker.

Hairpin and dumbbell type oligomeric compounds will have a duplex region equal to or at least 14, 15, 15, 16, 17, 18, 19, 29, 21, 22, 23, 24, or 25 nucleotide pairs. The duplex region can be equal to or less than 200, 100, or 50, in length. In some embodiments, ranges for the duplex region are 15-30, 17 to 23, 19 to 23, and 19 to 21 nucleotides pairs in length.

The hairpin oligomeric compounds can have a single strand overhang or terminal unpaired region, in some embodiments at the 3', and in some embodiments on the antisense side of the hairpin. In some embodiments, the overhangs are 1-4, more generally 2-3 nucleotides in length. The hairpin oligomeric compounds that can induce RNA interference are also referred to as "shRNA" herein.

Where the two substantially complementary strands of a dsRNA are comprised by separate RNA molecules, those molecules need not be, but can be covalently connected. Where the two strands are connected covalently by means other than an uninterrupted chain of nucleotides between the 3'-end of one strand and the 5'-end of the respective other strand forming the duplex structure, the connecting structure is referred to as a "linker." The RNA strands may have the same or a different number of nucleotides. The maximum number of base pairs is the number of nucleotides in the shortest strand of the dsRNA minus any overhangs that are present in the duplex. In addition to the duplex structure, an RNAi may comprise one or more nucleotide overhangs. In one embodiment of the RNAi agent, at least one strand comprises a 3' overhang of at least 1 nucleotide. In another embodiment, at least one strand comprises a 3' overhang of at least 2 nucleotides, e.g., 2, 3, 4, 5, 6, 7, 9, 10, 11, 12, 13, 14, or 15 nucleotides. In other embodiments, at least one strand of the RNAi agent comprises a 5' overhang of at least 1 nucleotide. In certain embodiments, at least one strand comprises a 5' overhang of at least 2 nucleotides, e.g., 2, 3, 4, 5, 6, 7, 9, 10, 11, 12, 13, 14, or 15 nucleotides. In still other embodiments, both the 3' and the 5' end of one strand of the RNAi agent comprise an overhang of at least 1 nucleotide.

In certain embodiments, an iRNA agent of the invention is a dsRNA, each strand of which comprises 19-23 nucleotides, that interacts with a target RNA sequence, e.g., a complement factor B (CFB) gene, to direct cleavage of the target RNA.

In some embodiments, an iRNA of the invention is a dsRNA of 24-30 nucleotides that interacts with a target RNA sequence, e.g., a CFB target mRNA sequence, to direct cleavage of the target RNA.

As used herein, the term "nucleotide overhang" refers to at least one unpaired nucleotide that protrudes from the duplex structure of a double stranded iRNA. For example, when a 3'-end of one strand of a dsRNA extends beyond the 5'-end of the other strand, or vice versa, there is a nucleotide overhang. A dsRNA can comprise an overhang of at least one nucleotide; alternatively, the overhang can comprise at least two nucleotides, at least three nucleotides, at least four nucleotides, at least five nucleotides or more. A nucleotide overhang can comprise or consist of a nucleotide/nucleoside analog, including a deoxynucleotide/nucleoside. The overhang(s) can be on the sense strand, the antisense strand, or any combination thereof. Furthermore, the nucleotide(s) of an overhang can be present on the 5'-end, 3'-end, or both ends of either an antisense or sense strand of a dsRNA.

In one embodiment of the dsRNA, at least one strand comprises a 3' overhang of at least 1 nucleotide. In another embodiment, at least one strand comprises a 3' overhang of at least 2 nucleotides, e.g., 2, 3, 4, 5, 6, 7, 9, 10, 11, 12, 13, 14, or 15 nucleotides. In other embodiments, at least one strand of the RNAi agent comprises a 5' overhang of at least 1 nucleotide. In certain embodiments, at least one strand comprises a 5' overhang of at least 2 nucleotides, e.g., 2, 3, 4, 5, 6, 7, 9, 10, 11, 12, 13, 14, or 15 nucleotides. In still other embodiments, both the 3' and the 5' end of one strand of the RNAi agent comprise an overhang of at least 1 nucleotide.

In one embodiment, the antisense strand of a dsRNA has a 1-10 nucleotide, e.g., a 1, 2, 3, 4, 5, 6, 7, 8, 9, or 10 nucleotide, overhang at the 3'-end or the 5'-end. In one embodiment, the sense strand of a dsRNA has a 1-10 nucleotide, e.g., a 1, 2, 3, 4, 5, 6, 7, 8, 9, or 10 nucleotide, overhang at the 3'-end or the 5'-end. In another embodiment, one or more of the nucleotides in the overhang is replaced with a nucleoside thiophosphate.

In certain embodiments, the antisense strand of a dsRNA has a 1-10 nucleotides, e.g., a 1, 2, 3, 4, 5, 6, 7, 8, 9, or 10 nucleotide, overhang at the 3'-end or the 5'-end. In certain embodiments, the overhang on the sense strand or the antisense strand, or both, can include extended lengths longer than 10 nucleotides, e.g., 1-30 nucleotides, 2-30 nucleotides, 10-30 nucleotides, 10-25 nucleotides, 10-20 nucleotides, or 10-15 nucleotides in length. In certain embodiments, an extended overhang is on the sense strand of the duplex. In certain embodiments, an extended overhang is present on the 3' end of the sense strand of the duplex. In certain embodiments, an extended overhang is present on the 5' end of the sense strand of the duplex. In certain embodiments, an extended overhang is on the antisense strand of the duplex. In certain embodiments, an extended overhang is present on the 3'end of the antisense strand of the duplex. In certain embodiments, an extended overhang is present on the 5'end of the antisense strand of the duplex. In certain embodiments, one or more of the nucleotides in the extended overhang is replaced with a nucleoside thiophosphate. In certain embodiments, the overhang includes a self-complementary portion such that the overhang is capable of forming a hairpin structure that is stable under physiological conditions.

"Blunt" or "blunt end" means that there are no unpaired nucleotides at that end of the double stranded RNA agent, i.e., no nucleotide overhang. A "blunt ended" double stranded RNA agent is double stranded over its entire length, i.e., no nucleotide overhang at either end of the molecule. The RNAi agents of the invention include RNAi agents with no nucleotide overhang at one end (i.e., agents with one overhang and one blunt end) or with no nucleotide overhangs at either end. Most often such a molecule will be double-stranded over its entire length.

The term "antisense strand" or "guide strand" refers to the strand of an iRNA, e.g., a dsRNA, which includes a region that is substantially complementary to a target sequence, e.g., a CFB mRNA.

As used herein, the term "region of complementarity" refers to the region on the antisense strand that is substantially complementary to a sequence, for example a target sequence, e.g., a complement factor B nucleotide sequence, as defined herein. Where the region of complementarity is not fully complementary to the target sequence, the mismatches can be in the internal or terminal regions of the molecule. Generally, the most tolerated mismatches are in the terminal regions, e.g., within 5, 4, or 3 nucleotides of the 5'- or 3'-end of the iRNA. In some embodiments, a double stranded RNA agent of the invention includes a nucleotide mismatch in the antisense strand. In some embodiments, the antisense strand of the double stranded RNA agent of the invention includes no more than 4 mismatches with the target mRNA, e.g., the antisense strand includes 4, 3, 2, 1, or 0 mismatches with the target mRNA. In some embodiments, the antisense strand double stranded RNA agent of the invention includes no more than 4 mismatches with the sense strand, e.g., the antisense strand includes 4, 3, 2, 1, or 0 mismatches with the sense strand. In some embodiments, a double stranded RNA agent of the invention includes a nucleotide mismatch in the sense strand. In some embodiments, the sense strand of the double stranded RNA agent of the invention includes no more than 4 mismatches with the antisense strand, e.g., the sense strand includes 4, 3, 2, 1, or 0 mismatches with the antisense strand. In some embodiments, the nucleotide mismatch is, for example, within 5, 4, 3 nucleotides from the 3'-end of the iRNA. In another embodiment, the nucleotide mismatch is, for example, in the 3'-terminal nucleotide of the iRNA agent. In some embodiments, the mismatch(s) is not in the seed region.

Thus, an RNAi agent as described herein can contain one or more mismatches to the target sequence. In one embodiment, a RNAi agent as described herein contains no more than 3 mismatches (i.e., 3, 2, 1, or 0 mismatches). In one embodiment, an RNAi agent as described herein contains no more than 2 mismatches. In one embodiment, an RNAi agent as described herein contains no more than 1 mismatch. In one embodiment, an RNAi agent as described herein contains 0 mismatches. In certain embodiments, if the antisense strand of the RNAi agent contains mismatches to the target sequence, the mismatch can optionally be restricted to be within the last 5 nucleotides from either the 5'- or 3'-end of the region of complementarity. For example, in such embodiments, for a 23 nucleotide RNAi agent, the strand which is complementary to a region of a CFB gene, generally does not contain any mismatch within the central 13 nucleotides. The methods described herein or methods known in the art can be used to determine whether an RNAi agent containing a mismatch to a target sequence is effective in inhibiting the expression of a CFB gene. Consideration of the efficacy of RNAi agents with mismatches in inhibiting expression of a CFB gene is important, especially if the particular region of complementarity in a CFB gene is known to have polymorphic sequence variation within the population.

The term "sense strand" or "passenger strand" as used herein, refers to the strand of an iRNA that includes a region that is substantially complementary to a region of the antisense strand as that term is defined herein.

As used herein, "substantially all of the nucleotides are modified" are largely but not wholly modified and can include not more than 5, 4, 3, 2, or 1 unmodified nucleotides.

As used herein, the term "cleavage region" refers to a region that is located immediately adjacent to the cleavage site. The cleavage site is the site on the target at which cleavage occurs. In some embodiments, the cleavage region comprises three bases on either end of, and immediately adjacent to, the cleavage site. In some embodiments, the cleavage region comprises two bases on either end of, and immediately adjacent to, the cleavage site. In some embodiments, the cleavage site specifically occurs at the site bound by nucleotides 10 and 11 of the antisense strand, and the cleavage region comprises nucleotides 11, 12 and 13.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can be, for example, "stringent conditions", where stringent conditions can include: 400 mM NaCl, 40 mM PIPES pH 6.4, 1 mM EDTA, 50° C. or 70° C. for 12-16 hours followed by washing (see, e.g., "Molecular Cloning: A Laboratory Manual, Sambrook, et al. (1989) Cold Spring Harbor Laboratory Press). Other conditions, such as physiologically relevant conditions as can be encountered inside an organism, can apply. The skilled person will be able to determine the set of conditions most appropriate for a test of complementarity of two sequences in accordance with the ultimate application of the hybridized nucleotides.

Complementary sequences within an iRNA, e.g., within a dsRNA as described herein, include base-pairing of the oligonucleotide or polynucleotide comprising a first nucleotide sequence to an oligonucleotide or polynucleotide comprising a second nucleotide sequence over the entire length of one or both nucleotide sequences. Such sequences can be referred to as "fully complementary" with respect to each other herein. However, where a first sequence is referred to as "substantially complementary" with respect to a second sequence herein, the two sequences can be fully complementary, or they can form one or more, but generally not more than 5, 4, 3, or 2 mismatched base pairs upon hybridization for a duplex up to 30 base pairs, while retaining the ability to hybridize under the conditions most relevant to their ultimate application, e.g., inhibition of gene expression, in vitro or in vivo. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, can yet be referred to as "fully complementary" for the purposes described herein.

"Complementary" sequences, as used herein, can also include, or be formed entirely from, non-Watson-Crick base pairs or base pairs formed from non-natural and modified nucleotides, in so far as the above requirements with respect to their ability to hybridize are fulfilled. Such non-Watson-Crick base pairs include, but are not limited to, G:U Wobble or Hoogsteen base pairing.

The terms "complementary," "fully complementary" and "substantially complementary" herein can be used with respect to the base matching between the sense strand and the antisense strand of a dsRNA, or between two oligonucleotides or polynucleotides, such as the antisense strand of a double stranded RNA agent and a target sequence, as will be understood from the context of their use.

As used herein, a polynucleotide that is "substantially complementary to at least part of" a messenger RNA (mRNA) refers to a polynucleotide that is substantially complementary to a contiguous portion of the mRNA of interest (e.g., an mRNA encoding a complement factor B gene). For example, a polynucleotide is complementary to at least a part of a complement factor B mRNA if the sequence is substantially complementary to a non-interrupted portion of an mRNA encoding a complement factor B gene.

Accordingly, in some embodiments, the antisense polynucleotides disclosed herein are fully complementary to the target CFB sequence.

In other embodiments, the antisense polynucleotides disclosed herein are substantially complementary to the target CFB sequence and comprise a contiguous nucleotide sequence which is at least 80% complementary over its entire length to the equivalent region of the nucleotide sequence of any one of SEQ ID NOs: 1-7 or a fragment of any one of SEQ ID NOs: 1-7, such as about 85%, about 90%, about 91%, about 92%, about 93%, about 94%, about 95%, about 96%, about 97%, about 98%, or about 99% complementary.

In some embodiments, the antisense polynucleotides disclosed herein are substantially complementary to a fragment of a target CFB sequence and comprise a contiguous nucleotide sequence which is at least 80% complementary over its entire length to a fragment of SEQ ID NO: 1 selected from the group of nucleotides 504-526, 640-662, 641-663, 995-1017, 997-1019, 1034-1056, 1141-1163, 1145-1167, 1389-1411, 1473-1495, 1826-1848, 1828-1850, 1842-1864, 2242-2264, 2391-2413, 2393-2415, 2438-2460, or 2453-2475 of SEQ ID NO: 1, such as about 85%, about 90%, about 91%, about 92%, about 93%, about 94%, about 95%, about 96%, about 97%, about 98%, or about 99% complementary.

In other embodiments, the antisense polynucleotides disclosed herein are substantially complementary to the target CFB sequence and comprise a contiguous nucleotide sequence which is at least about 80% complementary over its entire length to any one of the sense strand nucleotide sequences in any one of any one of Tables 2-3, or a fragment of any one of the sense strand nucleotide sequences in any one of Tables 2-3, such as about 85%, about 90%, about 95%, or fully complementary.

In one embodiment, an RNAi agent of the disclosure includes a sense strand that is substantially complementary to an antisense polynucleotide which, in turn, is the same as a target CFB sequence, and wherein the sense strand polynucleotide comprises a contiguous nucleotide sequence which is at least about 80% complementary over its entire length to the equivalent region of the nucleotide sequence of SEQ ID NOs: 8-14, or a fragment of any one of SEQ ID NOs:8-14, such as about 85%, about 90%, about 95%, or fully complementary.

In some embodiments, an iRNA of the invention includes a sense strand that is substantially complementary to an antisense polynucleotide which, in turn, is complementary to a target complement factor B sequence, and wherein the sense strand polynucleotide comprises a contiguous nucleotide sequence which is at least about 80% complementary over its entire length to any one of the antisense strand nucleotide sequences in any one of any one of Tables 2-3, or a fragment of any one of the antisense strand nucleotide sequences in any one of Tables 2-3, such as about 85%, about 90%, about 95%, or fully complementary.

In some embodiments, the sense and antisense strands are selected from the group consisting of AD-1726057; AD-1725763; AD-1725777; AD-1725057; AD-1725096; AD-1728786; AD-1725059; AD-1728276; AD-1728278; AD-1726936; AD-1725472; AD-1724715; AD-1727292; AD-1730477; AD-1727288; AD-1730167; AD-1725408; and AD-1725761.

In one embodiment, the sense and antisense strands are selected from duplex AD-1726057.

In one embodiment, the sense and antisense strands are selected from duplex AD-1725763.

In one embodiment, the sense and antisense strands are selected from duplex AD-1725777.

In one embodiment, the sense and antisense strands are selected from duplex AD-1725057.

In one embodiment, the sense and antisense strands are selected from duplex AD-1725096.

In one embodiment, the sense and antisense strands are selected from duplex AD-1728786.

In one embodiment, the sense and antisense strands are selected from duplex AD-1725059.

In one embodiment, the sense and antisense strands are selected from duplex AD-1728276.

In one embodiment, the sense and antisense strands are selected from duplex AD-1728278.

In one embodiment, the sense and antisense strands are selected from duplex AD-1726936.

In one embodiment, the sense and antisense strands are selected from duplex AD-1725472.

In one embodiment, the sense and antisense strands are selected from duplex AD-1724715.

In one embodiment, the sense and antisense strands are selected from duplex AD-1727292.

In one embodiment, the sense and antisense strands are selected from duplex AD-1730477.

In one embodiment, the sense and antisense strands are selected from duplex AD-1727288.

In one embodiment, the sense and antisense strands are selected from duplex AD-1730167.

In one embodiment, the sense and antisense strands are selected from duplex AD-1725408.

In one embodiment, the sense and antisense strands are selected from duplex AD-1725761.

In some embodiments, the double-stranded region of a double-stranded iRNA agent is equal to or at least, 17, 18, 19, 20, 21, 22, 23, 23, 24, 25, 26, 27, 28, 29, 30 or more nucleotide pairs in length.

In some embodiments, the antisense strand of a double-stranded iRNA agent is equal to or at least 17, 18, 19, 20, 21, 22, 23, 23, 24, 25, 26, 27, 28, 29, or 30 nucleotides in length.

In some embodiments, the sense strand of a double-stranded iRNA agent is equal to or at least 17, 18, 19, 20, 21, 22, 23, 23, 24, 25, 26, 27, 28, 29, or 30 nucleotides in length.

In one embodiment, the sense and antisense strands of the double-stranded iRNA agent are each 18 to 30 nucleotides in length.

In one embodiment, the sense and antisense strands of the double-stranded iRNA agent are each 19 to 25 nucleotides in length.

In one embodiment, the sense and antisense strands of the double-stranded iRNA agent are each 21 to 23 nucleotides in length.

In one embodiment, the sense strand of the iRNA agent is 21-nucleotides in length, and the antisense strand is 23-nucleotides in length, wherein the strands form a double-stranded region of 21 consecutive base pairs having a 2-nucleotide long single stranded overhangs at the 3-end.

In some embodiments, the majority of nucleotides of each strand are ribonucleotides, but as described in detail herein, each or both strands can also include one or more non-ribonucleotides, e.g., a deoxyribonucleotide or a modified nucleotide. In addition, an "iRNA" may include ribonucleotides with chemical modifications. Such modifications may include all types of modifications disclosed herein or known in the art. Any such modifications, as used in an iRNA molecule, are encompassed by "iRNA" for the purposes of this specification and claims.

In certain embodiments of the instant disclosure, inclusion of a deoxy-nucleotide if present within an RNAi agent can be considered to constitute a modified nucleotide.

In one embodiment, at least partial suppression of the expression of a CFB gene, is assessed by a reduction of the amount of CFB mRNA which can be isolated from or detected in a first cell or group of cells in which a CFB gene is transcribed and which has or have been treated such that the expression of a CFB gene is inhibited, as compared to a second cell or group of cells substantially identical to the first cell or group of cells but which has or have not been so treated (control cells). The degree of inhibition may be expressed in terms of:

$$\frac{(mRNA \text{ in control cells}) - (mRNA \text{ in treated cells})}{(mRNA \text{ in control cells})} \cdot 100\%$$

The phrase "contacting a cell with an iRNA," such as a dsRNA, as used herein, includes contacting a cell by any possible means. Contacting a cell with an iRNA includes contacting a cell in vitro with the iRNA or contacting a cell in vivo with the iRNA. The contacting may be done directly or indirectly. Thus, for example, the iRNA may be put into physical contact with the cell by the individual performing the method, or alternatively, the iRNA may be put into a situation that will permit or cause it to subsequently come into contact with the cell.

Contacting a cell in vitro may be done, for example, by incubating the cell with the iRNA. Contacting a cell in vivo may be done, for example, by injecting the iRNA into or near the tissue where the cell is located, or by injecting the iRNA into another area, e.g., the bloodstream or the subcutaneous space, such that the agent will subsequently reach the tissue where the cell to be contacted is located. For example, the iRNA may contain or be coupled to a ligand, e.g., GalNAc, that directs the iRNA to a site of interest, e.g., the liver. Combinations of in vitro and in vivo methods of contacting are also possible. For example, a cell may also be contacted in vitro with an iRNA and subsequently transplanted into a subject.

In certain embodiments, contacting a cell with an iRNA includes "introducing" or "delivering the iRNA into the cell" by facilitating or effecting uptake or absorption into the cell. Absorption or uptake of an iRNA can occur through unaided diffusion or active cellular processes, or by auxiliary agents or devices. Introducing an iRNA into a cell may be in vitro or in vivo. For example, for in vivo introduction, iRNA can be injected into a tissue site or administered systemically. In vitro introduction into a cell includes methods known in the art such as electroporation and lipofection. Further approaches are described herein below or are known in the art.

The term "lipid nanoparticle" or "LNP" is a vesicle comprising a lipid layer encapsulating a pharmaceutically active molecule, such as a nucleic acid molecule, e.g., an iRNA or a plasmid from which an iRNA is transcribed. LNPs are described in, for example, U.S. Pat. Nos. 6,858,225, 6,815,432, 8,158,601, and 8,058,069, the entire contents of which are hereby incorporated herein by reference.

As used herein, a "subject" is an animal, such as a mammal, including a primate (such as a human, a non-human primate, e.g., a monkey, and a chimpanzee), a non-primate (such as a rabbit, a sheep, a hamster, a guinea pig, a dog, a rat, or a mouse), or a bird that expresses the target gene, either endogenously or heterologously. In an embodiment, the subject is a human, such as a human being treated or assessed for a disease or disorder that would benefit from reduction in CFB expression; a human at risk for a disease or disorder that would benefit from reduction in CFB expression; a human having a disease or disorder that would benefit from reduction in CFB expression; or human being treated for a disease or disorder that would benefit from reduction in CFB expression as described herein. In some embodiments, the subject is a female human. In other embodiments, the subject is a male human. In one embodiment, the subject is an adult subject. In another embodiment, the subject is a pediatric subject.

As used herein, the terms "treating" or "treatment" refer to a beneficial or desired result, such as reducing at least one sign or symptom of a CFB-associated disorder in a subject. Treatment also includes a reduction of one or more sign or symptoms associated with unwanted CFB expression; diminishing the extent of unwanted CFB activation or stabilization; amelioration or palliation of unwanted CFB activation or stabilization. "Treatment" can also mean prolonging survival as compared to expected survival in the absence of treatment.

The term "lower" in the context of the level of CFB in a subject or a disease marker or symptom refers to a statistically significant decrease in such level. The decrease can be, for example, at least 10%, 15%, 20%, 25%, 30%, %, 40%, 45%, 50%, 55%, 60%, 65%, 70%, 75%, 80%, 85%, 90%, 95%, or more. In certain embodiments, a decrease is at least 20%. In certain embodiments, the decrease is at least 50% in a disease marker, e.g., protein or gene expression level. "Lower" in the context of the level of CFB in a subject is a decrease to a level accepted as within the range of normal for an individual without such disorder. In certain embodiments, the expression of the target is normalized, i.e., decreased towards or to a level accepted as within the range of normal for an individual without such disorder, e.g., normalization of body weight, blood pressure, or a serum lipid level. As used here, "lower" in a subject can refer to lowering of gene expression or protein production in a cell in a subject does not require lowering of expression in all cells or tissues of a subject. For example, as used herein, lowering in a subject can include lowering of gene expression or protein production in the liver of a subject.

The term "lower" can also be used in association with normalizing a symptom of a disease or condition, i.e. decreasing the difference between a level in a subject suffering from a CFB-associated disease towards or to a level in a normal subject not suffering from a CFB-associated disease. For example, if a subject with a normal weight of 70 kg weighs 90 kg prior to treatment (20 kg overweight) and 80 kg after treatment (10 kg overweight), the subject's weight is lowered towards a normal weight by 50% (10/20× 100%). Similarly, if the HDL level of a woman is increased from 50 mg/dL (poor) to 57 mg/dL, with a normal level being 60 mg/dL, the difference between the prior level of the subject and the normal level is decreased by 70% (difference of 10 mg/dL between subject level and normal is decreased by 7 mg/dL, 7/10×100%). As used herein, if a disease is associated with an elevated value for a symptom, "normal" is considered to be the upper limit of normal. If a disease is associated with a decreased value for a symptom, "normal" is considered to be the lower limit of normal.

As used herein, "prevention" or "preventing," when used in reference to a disease, disorder or condition thereof, that would benefit from a reduction in expression of a CFB gene or production of CFB protein, refers to preventing a subject who has at least one sign or symptom of a disease from developing further signs and symptoms thereby meeting the diagnostic criteria for that disease. In certain embodiments, prevention includes delayed progression to meeting the diagnostic criteria of the disease by days, weeks, months or years as compared to what would be predicted by natural history studies or the typical progression of the disease.

As used herein, the term "complement factor B disease" or "CFB-associated disease," is a disease or disorder that is caused by, or associated with, complement activation. The term "CFB-associated disease" includes a disease, disorder or condition that would benefit from a decrease in CFB gene expression, replication, or protein activity. Non-limiting examples of CFB-associated diseases include, for example, paroxysmal nocturnal hemoglobinuria (PNH), atypical hemolytic uremic syndrome (aHUS), asthma, rheumatoid arthritis (RA); antiphospholipid antibody syndrome; lupus nephritis; ischemia-reperfusion injury; typical or infectious hemolytic uremic syndrome (tHUS); dense deposit disease (DDD); neuromyelitis optica (NMO); multifocal motor neuropathy (MMN); multiple sclerosis (MS); macular degeneration (e.g., age-related macular degeneration (AMD)); hemolysis, elevated liver enzymes, and low platelets (HELLP) syndrome; thrombotic thrombocytopenic purpura (TTP); spontaneous fetal loss; Pauci-immune vasculitis; epidermolysis bullosa; recurrent fetal loss; pre-eclampsia, traumatic brain injury, myasthenia gravis, cold agglutinin disease, dermatomyositis bullous pemphigoid, Shiga toxin *E. coli*-related hemolytic uremic syndrome, C3 neuropathy, anti-neutrophil cytoplasmic antibody-associated vasculitis (e.g., granulomatosis with polyangiitis (previously known as Wegener granulomatosis), Churg-Strauss syndrome, and microscopic polyangiitis), humoral and vascular transplant rejection, graft dysfunction, myocardial infarction (e.g., tissue damage and ischemia in myocardial infarction), an allogenic transplant, sepsis (e.g., poor outcome in sepsis), Coronary artery disease, dermatomyositis, Graves' disease, atherosclerosis, Alzheimer's disease, systemic inflammatory response sepsis, septic shock, spinal cord injury, glomerulonephritis, Hashimoto's thyroiditis, type I diabetes, psoriasis, pemphigus, autoimmune hemolytic anemia (AIHA), ITP, Goodpasture syndrome, Degos disease, antiphospholipid syndrome (APS), catastrophic APS (CAPS), a cardiovascular disorder, myocarditis, a cerebrovascular disorder, a peripheral (e.g., musculoskeletal) vascular disorder, a renovascular disorder, a mesenteric/enteric vascular disorder, vasculitis, Henoch-Schönlein purpura nephritis, systemic lupus erythematosus-associated vasculitis, vasculitis associated with rheumatoid arthritis, immune complex vasculitis, Takayasu's disease, dilated cardiomyopathy, diabetic angiopathy, Kawasaki's disease (arteritis), venous gas embolus (VGE), and restenosis following stent placement, rotational atherectomy, and percutaneous transluminal coronary angioplasty (PTCA) (see, e.g., Holers (2008) *Immunological Reviews* 223:300-316; Holers and Thurman (2004) *Molecular Immunology* 41:147-152; U.S. Patent Publication No. 20070172483).

In one embodiment, the complement factor B-associate disease is selected from the group consisting of C3 glomerulopathy, systemic lupus erythematosus (SLE), e.g., Lupus Nephritis, IgA nephropathy, diabetic nephropathy, polycystic kidney disease, membranous nephropathy, age-related macular degeneration, atypical hemolytic uremic syndrome, thrombotic microangiopathy, myasthenia gravis, ischemia and reperfusion injury, paroxysmal nocturnal hemoglobinuria, and rheumatoid arthritis In another embodiment, the complement factor B-associate disease is selected from the group consisting of C3 glomerulopathy, systemic lupus erythematosus (SLE), e.g., Lupus Nephritis, IgA nephropathy, diabetic nephropathy, and polycystic kidney disease.

Further details regarding signs and symptoms of the various diseases or conditions are provided herein and are well known in the art.

"Therapeutically effective amount," as used herein, is intended to include the amount of an RNAi agent that, when administered to a subject having a CFB-associated disease, is sufficient to effect treatment of the disease (e.g., by diminishing, ameliorating, or maintaining the existing disease or one or more symptoms of disease). The "therapeutically effective amount" may vary depending on the RNAi agent, how the agent is administered, the disease and its severity and the history, age, weight, family history, genetic makeup, the types of preceding or concomitant treatments, if any, and other individual characteristics of the subject to be treated.

"Prophylactically effective amount," as used herein, is intended to include the amount of an RNAi agent that, when administered to a subject having at least one sign or symptom of a CFB-associated disorder, is sufficient to prevent or delay the subject's progression to meeting the full diagnostic criteria of the disease. Prevention of the disease includes slowing the course of progression to full blown disease. The "prophylactically effective amount" may vary depending on the RNAi agent, how the agent is administered, the degree of risk of disease, and the history, age, weight, family history, genetic makeup, the types of preceding or concomitant treatments, if any, and other individual characteristics of the patient to be treated.

A "therapeutically-effective amount" or "prophylactically effective amount" also includes an amount of an RNAi agent that produces some desired effect at a reasonable benefit/risk ratio applicable to any treatment. The iRNA employed in the methods of the present invention may be administered in a sufficient amount to produce a reasonable benefit/risk ratio applicable to such treatment.

The phrase "pharmaceutically acceptable" is employed herein to refer to those compounds, materials, compositions, or dosage forms which are, within the scope of sound medical judgment, suitable for use in contact with the tissues of human subjects and animal subjects without excessive toxicity, irritation, allergic response, or other problem or complication, commensurate with a reasonable benefit/risk ratio.

The phrase "pharmaceutically-acceptable carrier" as used herein means a pharmaceutically-acceptable material (including salts), composition, or vehicle, such as a liquid or solid filler, diluent, excipient, manufacturing aid (e.g., lubricant, talc magnesium, calcium or zinc stearate, or steric acid), or solvent encapsulating material, involved in carrying or transporting the subject compound from one organ, or portion of the body, to another organ, or portion of the body. Each carrier must be "acceptable" in the sense of being compatible with the other ingredients of the formulation and not injurious to the subject being treated. Such carriers are known in the art. Pharmaceutically acceptable carriers include carriers for administration by injection.

The term "sample," as used herein, includes a collection of similar fluids, cells, or tissues isolated from a subject, as well as fluids, cells, or tissues present within a subject. Examples of biological fluids include blood, serum and serosal fluids, plasma, cerebrospinal fluid, ocular fluids, lymph, urine, saliva, and the like. Tissue samples may include samples from tissues, organs, or localized regions. For example, samples may be derived from particular organs, parts of organs, or fluids or cells within those organs. In certain embodiments, samples may be derived from the liver (e.g., whole liver or certain segments of liver or certain types of cells in the liver, such as, e.g., hepatocytes). In some embodiments, a "sample derived from a subject" refers to urine obtained from the subject. A "sample derived from a subject" can refer to blood or blood derived serum or plasma from the subject.

II. iRNAs of the Invention

The present invention provides iRNAs which inhibit the expression of a complement factor B gene. In certain embodiments, the iRNA includes double stranded ribonucleic acid (dsRNA) molecules for inhibiting the expression of a CFB gene in a cell, such as a cell within a subject, e.g., a mammal, such as a human susceptible to developing a complement factor B-associated disorder. The dsRNAi agent includes an antisense strand having a region of complementarity which is complementary to at least a part of an mRNA formed in the expression of a CFB gene. The region of complementarity is about 19-30 nucleotides in length (e.g., about 30, 29, 28, 27, 26, 25, 24, 23, 22, 21, 20, or 19 nucleotides in length). Upon contact with a cell expressing the CFB gene, the iRNA inhibits the expression of the CFB gene (e.g., a human, a primate, a non-primate, or a rat CFB gene) by at least about 50% as assayed by, for example, a PCR or branched DNA (bDNA)-based method, or by a protein-based method, such as by immunofluorescence analysis, using, for example, western blotting or flow cytometric techniques. In certain embodiments, inhibition of expression is determined by the qPCR method provided in the examples herein with the siRNA at, e.g., a 10 nM concentration, in an appropriate organism cell line provided therein. In certain embodiments, inhibition of expression in vivo is determined by knockdown of the human gene in a rodent expressing the human gene, e.g., a mouse or an AAV-infected mouse expressing the human target gene, e.g., when administered as single dose, e.g., at 3 mg/kg at the nadir of RNA expression.

A dsRNA includes two RNA strands that are complementary and hybridize to form a duplex structure under conditions in which the dsRNA will be used. One strand of a dsRNA (the antisense strand) includes a region of complementarity that is substantially complementary, and generally fully complementary, to a target sequence. The target sequence can be derived from the sequence of an mRNA formed during the expression of a CFB gene. The other strand (the sense strand) includes a region that is complementary to the antisense strand, such that the two strands hybridize and form a duplex structure when combined under suitable conditions. As described elsewhere herein and as known in the art, the complementary sequences of a dsRNA can also be contained as self-complementary regions of a single nucleic acid molecule, as opposed to being on separate oligonucleotides.

Generally, the duplex structure is 15 to 30 base pairs in length, e.g., 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. In certain embodiments, the duplex structure is 18 to 25 base pairs in length, e.g., 18-25, 18-24, 18-23, 18-22, 18-21, 18-20, 19-25, 19-24, 19-23, 19-22, 19-21, 19-20, 20-25, 20-24, 20-23, 20-22, 20-21, 21-25, 21-24, 21-23, 21-22, 22-25, 22-24, 22-23, 23-25, 23-24 or 24-25 base pairs in length, for example, 19-21 basepairs in length. Ranges and lengths intermediate to the above recited ranges and lengths are also contemplated to be part of the disclosure.

Similarly, the region of complementarity to the target sequence is 15 to 30 nucleotides in length, e.g., 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length, for example 19-23 nucleotides in length or 21-23 nucleotides in length. Ranges and lengths intermediate to the above recited ranges and lengths are also contemplated to be part of the disclosure.

In some embodiments, the duplex structure is 19 to 30 base pairs in length. Similarly, the region of complementarity to the target sequence is 19 to 30 nucleotides in length.

In some embodiments, the dsRNA is about 19 to about 23 nucleotides in length, or about 25 to about 30 nucleotides in length. In general, the dsRNA is long enough to serve as a substrate for the Dicer enzyme. For example, it is well-known in the art that dsRNAs longer than about 21-23 nucleotides in length may serve as substrates for Dicer. As the ordinarily skilled person will also recognize, the region of an RNA targeted for cleavage will most often be part of a larger RNA molecule, often an mRNA molecule. Where relevant, a "part" of an mRNA target is a contiguous sequence of an mRNA target of sufficient length to allow it to be a substrate for RNAi-directed cleavage (i.e., cleavage through a RISC pathway).

One of skill in the art will also recognize that the duplex region is a primary functional portion of a dsRNA, e.g., a duplex region of about 19 to about 30 base pairs, e.g., about 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs. Thus, in one embodiment, to the extent that it becomes processed to a functional duplex, of e.g., 15-30 base pairs, that targets a desired RNA for cleavage, an RNA molecule or complex of RNA molecules having a duplex region greater than 30 base pairs is a dsRNA. Thus, an ordinarily skilled artisan will recognize that in one embodiment, a miRNA is a dsRNA. In another embodiment, a dsRNA is not a naturally occurring miRNA. In another embodiment, an iRNA agent useful to target complement factor B gene expression is not generated in the target cell by cleavage of a larger dsRNA.

A dsRNA as described herein can further include one or more single-stranded nucleotide overhangs e.g., 1-4, 2-4, 1-3, 2-3, 1, 2, 3, or 4 nucleotides. dsRNAs having at least one nucleotide overhang can have superior inhibitory properties relative to their blunt-ended counterparts. A nucleotide overhang can comprise or consist of a nucleotide/nucleoside analog, including a deoxynucleotide/nucleoside. The overhang(s) can be on the sense strand, the antisense strand, or any combination thereof. Furthermore, the nucleotide(s) of an overhang can be present on the 5'-end, 3'-end, or both ends of an antisense or sense strand of a dsRNA.

A dsRNA can be synthesized by standard methods known in the art. Double stranded RNAi compounds of the invention may be prepared using a two-step procedure. First, the individual strands of the double stranded RNA molecule are prepared separately. Then, the component strands are annealed. The individual strands of the siRNA compound can be prepared using solution-phase or solid-phase organic synthesis or both. Organic synthesis offers the advantage that the oligonucleotide strands comprising unnatural or modified nucleotides can be easily prepared. Similarly, single-stranded oligonucleotides of the invention can be prepared using solution-phase or solid-phase organic synthesis or both.

Regardless of the method of synthesis, the siRNA preparation can be prepared in a solution (e.g., an aqueous or organic solution) that is appropriate for formulation. For example, the siRNA preparation can be precipitated and redissolved in pure double-distilled water, and lyophilized. The dried siRNA can then be resuspended in a solution appropriate for the intended formulation process.

In an aspect, a dsRNA of the invention includes at least two nucleotide sequences, a sense sequence and an antisense sequence. The sense strand is selected from the group of sequences provided in any one of Tables 2-3, and the corresponding antisense strand of the sense strand is selected from the group of sequences of any one of Tables 2-3. In this aspect, one of the two sequences is complementary to the other of the two sequences, with one of the sequences being substantially complementary to a sequence of an mRNA generated in the expression of a complement factor B gene. As such, in this aspect, a dsRNA will include two oligonucleotides, where one oligonucleotide is described as the sense strand in any one of Tables 2-3, and the second oligonucleotide is described as the corresponding antisense strand of the sense strand in any one of Tables 2-3.

In certain embodiments, the substantially complementary sequences of the dsRNA are contained on separate oligonucleotides. In other embodiments, the substantially complementary sequences of the dsRNA are contained on a single oligonucleotide.

It will be understood that, although the sequences in Table 2 are not described as modified or conjugated sequences, the RNA of the iRNA of the invention e.g., a dsRNA of the invention, may comprise any one of the sequences set forth in any one of Tables 2-3 that is un-modified, un-conjugated, or modified or conjugated differently than described therein. In other words, the invention encompasses dsRNA of Tables 2-3 which are un-modified, un-conjugated, modified, or conjugated, as described herein.

The skilled person is well aware that dsRNAs having a duplex structure of about 20 to 23 base pairs, e.g., 21, base pairs have been hailed as particularly effective in inducing RNA interference (Elbashir et al., *EMBO* 2001, 20:6877-6888). However, others have found that shorter or longer RNA duplex structures can also be effective (Chu and Rana (2007) *RNA* 14:1714-1719; Kim et al. (2005) *Nat Biotech* 23:222-226). In the embodiments described above, by virtue of the nature of the oligonucleotide sequences provided in any one of Tables 2-3, dsRNAs described herein can include at least one strand of a length of minimally 21 nucleotides. It can be reasonably expected that shorter duplexes having any one of the sequences in any one of Tables 2-3 minus only a few nucleotides on one or both ends can be similarly effective as compared to the dsRNAs described above. Hence, dsRNAs having a sequence of at least 19, 20, or more contiguous nucleotides derived from any one of the sequences of any one of Tables 2-3, and differing in their ability to inhibit the expression of a complement factor B gene by not more than about 5, 10, 15, 20, 25, or 30% inhibition from a dsRNA comprising the full sequence, are contemplated to be within the scope of the present invention.

In addition, the RNAs provided in Tables 2-3 identify a site(s) in a complement factor B transcript that is susceptible to RISC-mediated cleavage. As such, the present invention further features iRNAs that target within one of these sites. As used herein, an iRNA is said to target within a particular site of an RNA transcript if the iRNA promotes cleavage of the transcript anywhere within that particular site. Such an iRNA will generally include at least about 19 contiguous nucleotides from any one of the sequences provided in any one of Tables 2-3 coupled to additional nucleotide sequences taken from the region contiguous to the selected sequence in a complement factor B gene.

An RNAi agent as described herein can contain one or more mismatches to the target sequence. In one embodiment, an RNAi agent as described herein contains no more than 3 mismatches (i.e., 3, 2, 1, or 0 mismatches). In one embodiment, an RNAi agent as described herein contains no more than 2 mismatches. In one embodiment, an RNAi agent as described herein contains no more than 1 mismatch. In one embodiment, an RNAi agent as described herein contains 0 mismatches. In certain embodiments, if the antisense strand of the RNAi agent contains mismatches to the target sequence, the mismatch can optionally be restricted to be within the last 5 nucleotides from either the 5'- or 3'-end of the region of complementarity. For example, in such embodiments, for a 23 nucleotide RNAi agent, the strand which is complementary to a region of a CFB gene generally does not contain any mismatch within the central 13 nucleotides. The methods described herein or methods known in the art can be used to determine whether an RNAi agent containing a mismatch to a target sequence is effective in inhibiting the expression of a CFB gene. Consideration of the efficacy of RNAi agents with mismatches in inhibiting expression of a CFB gene is important, especially if the particular region of complementarity in a CFB gene is known to have polymorphic sequence variation within the population.

III. Modified iRNAs of the Invention

In certain embodiments, the RNA of the iRNA of the invention e.g., a dsRNA, is un-modified, and does not comprise, e.g., chemical modifications or conjugations known in the art and described herein. In other embodiments, the RNA of an iRNA of the invention, e.g., a dsRNA, is chemically modified to enhance stability or other beneficial characteristics. In certain embodiments of the invention, substantially all of the nucleotides of an iRNA of the invention are modified. In other embodiments of the invention, all of the nucleotides of an iRNA or substantially all of the nucleotides of an iRNA are modified, i.e., not more than 5, 4, 3, 2, or 1 unmodified nucleotides are present in a strand of the iRNA.

The nucleic acids featured in the invention can be synthesized or modified by methods well established in the art, such as those described in "Current protocols in nucleic acid chemistry," Beaucage, S. L. et al. (Edrs.), John Wiley & Sons, Inc., New York, NY, USA, which is hereby incorporated herein by reference. Modifications include, for example, end modifications, e.g., 5'-end modifications (phosphorylation, conjugation, inverted linkages) or 3'-end modifications (conjugation, DNA nucleotides, inverted linkages, etc.); base modifications, e.g., replacement with stabilizing bases, destabilizing bases, or bases that base pair with an expanded repertoire of partners, removal of bases (abasic nucleotides), or conjugated bases; sugar modifications (e.g., at the 2'-position or 4'-position) or replacement of the sugar; or backbone modifications, including modification or replacement of the phosphodiester linkages. Specific examples of iRNA compounds useful in the embodiments described herein include, but are not limited to RNAs containing modified backbones or no natural internucleoside linkages. RNAs having modified backbones include, among others, those that do not have a phosphorus atom in the backbone. For the purposes of this specification, and as sometimes referenced in the art, modified RNAs that do not have a phosphorus atom in their internucleoside backbone can also be considered to be oligonucleosides. In some embodiments, a modified iRNA will have a phosphorus atom in its internucleoside backbone.

Modified RNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5'-linked analogs of these, and those having inverted polarity wherein the adjacent pairs of nucleoside units are linked 3'-5' to 5'-3' or 2'-5' to 5'-2'. Various salts, mixed salts and free acid forms are also included. In some embodiments of the invention, the dsRNA agents of the invention are in a free acid form. In other embodiments of the invention, the dsRNA agents of the invention are in a salt form. In one embodiment, the dsRNA agents of the invention are in a sodium salt form. In certain embodiments, when the dsRNA agents of the invention are in the sodium salt form, sodium ions are present in the agent as counterions for substantially all of the phosphodiester or phosphorothioate groups present in the agent. Agents in which substantially all of the phosphodiester or phosphorothioate linkages have a sodium counterion include not more than 5, 4, 3, 2, or 1 phosphodiester or phosphorothioate linkages without a sodium counterion. In some embodiments, when the dsRNA agents of the invention are in the sodium salt form, sodium ions are present in the agent as counterions for all of the phosphodiester or phosphorothioate groups present in the agent.

Representative U.S. patents that teach the preparation of the above phosphorus-containing linkages include, but are not limited to, U.S. Pat. Nos. 3,687,808; 4,469,863; 4,476,301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,316; 5,550,111; 5,563,253; 5,571,799; 5,587,361; 5,625,050; 6,028,188; 6,124,445; 6,160,109; 6,169,170; 6,172,209; 6,239,265; 6,277,603; 6,326,199; 6,346,614; 6,444,423; 6,531,590; 6,534,639; 6,608,035; 6,683,167; 6,858,715; 6,867,294; 6,878,805; 7,015,315; 7,041,816; 7,273,933; 7,321,029; and U.S. Pat. RE39464, the entire contents of each of which are hereby incorporated herein by reference.

Modified RNA backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S, and $CH_2$ component parts.

Representative U.S. patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and 5,677,439, the entire contents of each of which are hereby incorporated herein by reference.

Suitable RNA mimetics are contemplated for use in iRNAs provided herein, in which both the sugar and the internucleoside linkage, i.e., the backbone, of the nucleotide units are replaced with novel groups. The base units are maintained for hybridization with an appropriate nucleic acid target compound. One such oligomeric compound in which an RNA mimetic that has been shown to have excellent hybridization properties is referred to as a peptide nucleic acid (PNA). In PNA compounds, the sugar backbone of an RNA is replaced with an amide containing backbone, in particular an aminoethylglycine backbone. The nucleobases are retained and are bound directly or indirectly to aza nitrogen atoms of the amide portion of the backbone. Representative US patents that teach the preparation of PNA compounds include, but are not limited to, U.S. Pat. Nos. 5,539,082; 5,714,331; and 5,719,262, the entire contents of each of which are hereby incorporated herein by reference. Additional PNA compounds suitable for use in the iRNAs of the invention are described in, for example, in Nielsen et al., *Science,* 1991, 254, 1497-1500.

Some embodiments featured in the invention include RNAs with phosphorothioate backbones and oligonucleosides with heteroatom backbones, and in particular —$CH_2$—NH—$CH_2$—, —$CH_2$—N($CH_3$)—O—$CH_2$— [known as a methylene (methylimino) or MMI backbone], —$CH_2$—O—N($CH_3$)—$CH_2$—, —$CH_2$—N($CH_3$)—N($CH_3$)—$CH_2$— and —N($CH_3$)—$CH_2$—$CH_2$— of the above-referenced U.S. Pat. No. 5,489,677, and the amide backbones of the above-referenced U.S. Pat. No. 5,602,240. In some embodiments, the RNAs featured herein have morpholino backbone structures of the above-referenced U.S. Pat. No. 5,034,506. The native phosphodiester backbone can be represented as O—P(O)(OH)—O$CH_2$—.

Modified RNAs can also contain one or more substituted sugar moieties. The iRNAs, e.g., dsRNAs, featured herein can include one of the following at the 2'-position: OH; F; O-, S-, or N-alkyl; O-, S-, or N-alkenyl; O-, S- or N-alkynyl; or O-alkyl-O-alkyl, wherein the alkyl, alkenyl and alkynyl can be substituted or unsubstituted $C_1$ to $C_{10}$ alkyl or $C_2$ to $C_{10}$ alkenyl and alkynyl. Exemplary suitable modifications include $O[(CH_2)_nO]_mCH_3$, $O(CH_2)_n OCH_3$, $O(CH_2)_nNH_2$, $O(CH_2)_nCH_3$, $O(CH_2)_nONH_2$, and $O(CH_2)_nON[(CH_2)_nCH_3)]_2$, where n and m are from 1 to about 10. In other embodiments, dsRNAs include one of the following at the 2' position: $C_1$ to $C_{10}$ lower alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an iRNA, or a group for improving the pharmacodynamic properties of an iRNA, and other substituents having similar properties. In some embodiments, the modification includes a 2'-methoxyethoxy (2'-O—$CH_2CH_2OCH_3$, also known as 2'-O-(2-methoxyethyl) or 2'-MOE) (Martin et al., Helv. Chim. Acta, 1995, 78:486-504) i.e., an alkoxy-alkoxy group. Another exemplary modification is 2'-dimethylaminooxyethoxy, i.e., a $O(CH_2)_2ON(CH_3)_2$ group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—$CH_2$—O—$CH_2$—$N(CH_2)_2$. Further exemplary modifications include: 5'-Me-2'-F nucleotides, 5'-Me-2'-OMe nucleotides, 5'-Me-2'-deoxynucleotides, (both R and S isomers in these three families); 2'-alkoxyalkyl; and 2'-NMA (N-methylacetamide).

Other modifications include 2'-methoxy (2'-$OCH_3$), 2'-aminopropoxy (2'-$OCH_2CH_2CH_2NH_2$) and 2'-fluoro (2'-F). Similar modifications can also be made at other positions on the RNA of an iRNA, particularly the 3' position of the sugar on the 3' terminal nucleotide or in 2-5' linked dsRNAs and the 5' position of 5' terminal nucleotide. iRNAs can also have sugar mimetics such as cyclobutyl moieties in place of the pentofuranosyl sugar. Representative US patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application. The entire contents of each of the foregoing are hereby incorporated herein by reference.

An iRNA can also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C), and uracil (U). Modified nucleobases include other synthetic and natural nucleobases such as deoxythimidine (dT), 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. Further nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in The Concise Encyclopedia Of Polymer Science And Engineering, pages 858-859, Kroschwitz, J. L, ed. John Wiley & Sons, 1990, these disclosed by Englisch et al., Angewandte Chemie, International Edition, 1991, 30, 613, and those disclosed by Sanghvi, Y S., Chapter 15, dsRNA Research and Applications, pages 289-302, Crooke, S. T. and Lebleu, B., Ed., CRC Press, 1993. Certain of these nucleobases are particularly useful for increasing the binding affinity of the oligomeric compounds featured in the invention. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., dsRNA Research and Applications, CRC Press, Boca Raton, 1993, pp. 276-278) and are exemplary base substitutions, even more particularly when combined with 2'-O-methoxyethyl sugar modifications.

Representative U.S. patents that teach the preparation of certain of the above noted modified nucleobases as well as other modified nucleobases include, but are not limited to, the above noted U.S. Pat. Nos. 3,687,808, 4,845,205; 5,130, 30; 5,134,066; 5,175,273; 5,367,066; 5,432,272; 5,457,187; 5,459,255; 5,484,908; 5,502,177; 5,525,711; 5,552,540; 5,587,469; 5,594,121; 5,596,091; 5,614,617; 5,681,941; 5,750,692; 6,015,886; 6,147,200; 6,166,197; 6,222,025; 6,235,887; 6,380,368; 6,528,640; 6,639,062; 6,617,438; 7,045,610; 7,427,672; and 7,495,088, the entire contents of each of which are hereby incorporated herein by reference.

In some embodiments, an iRNA agent of the disclosure can also be modified to include one or more bicyclic sugar moieties. A "bicyclic sugar" is a furanosyl ring modified by the bridging of two atoms. A "bicyclic sugar" is a furanosyl ring modified by a ring formed by the bridging of two carbons, whether adjacent or non-adjacent atoms. A "bicyclic nucleoside" ("BNA") is a nucleoside having a sugar moiety comprising a bridge a ring formed by bridging connecting two carbons, whether adjacent or non-adjacent, atoms of the sugar ring, thereby forming a bicyclic ring system. In certain embodiments, the bridge connects the 4'-carbon and the 2'-carbon of the sugar ring, optionally, via the 2'-acyclic oxygen atoms. Thus, in some embodiments an agent of the invention may include one or more locked nucleic acids (LNA). A locked nucleic acid is a nucleotide having a modified ribose moiety in which the ribose moiety comprises an extra bridge connecting the 2' and 4' carbons. In other words, an LNA is a nucleotide comprising a bicyclic sugar moiety comprising a 4'-$CH_2$—O-2' bridge. This structure effectively "locks" the ribose in the 3'-endo structural conformation. The addition of locked nucleic acids to siRNAs has been shown to increase siRNA stability in serum, and to reduce off-target effects (Elmen, J. et al., (2005) Nucleic Acids Research 33(1):439-447; Mook, O R. et al., (2007) Mol Canc Ther 6(3):833-843; Grunweller, A. et al., (2003) Nucleic Acids Research 31(12):3185-3193). Examples of bicyclic nucleosides for use in the polynucleotides of the invention include without limitation nucleosides comprising a bridge between the 4' and the 2' ribosyl ring atoms. In certain embodiments, the antisense polynucleotide agents of the invention include one or more bicyclic nucleosides comprising a 4' to 2' bridge.

A locked nucleoside can be represented by the structure (omitting stereochemistry),

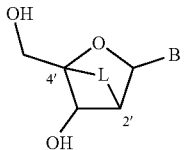

wherein B is a nucleobase or modified nucleobase and L is the linking group that joins the 2'-carbon to the 4'-carbon of the ribose ring.

Examples of such 4' to 2' bridged bicyclic nucleosides, include but are not limited to 4'-(CH$_2$)—O-2' (LNA); 4'-(CH$_2$)—S-2'; 4'-(CH$_2$)$_2$—O-2' (ENA); 4'-CH(CH$_3$)—O-2' (also referred to as "constrained ethyl" or "cEt") and 4'-CH (CH$_2$OCH$_3$)—O-2' (and analogs thereof; see, e.g., U.S. Pat. No. 7,399,845); 4'-C(CH$_3$)(CH$_3$)—O-2' (and analogs thereof; see e.g., U.S. Pat. No. 8,278,283); 4'-CH$_2$—N (OCH$_3$)-2' (and analogs thereof; see e.g., U.S. Pat. No. 8,278,425); 4'-CH$_2$—O—N(CH$_3$)-2' (see, e.g., U.S. Patent Publication No. 2004/0171570); 4'-CH$_2$—N(R)—O-2', wherein R is H, C1-C12 alkyl, or a nitrogen protecting group (see, e.g., U.S. Pat. No. 7,427,672); 4'-CH$_2$—C(H)(CH$_3$)-2' (see, e.g., Chattopadhyaya et al., *J. Org. Chem.*, 2009, 74, 118-134); and 4'-CH$_2$—C(=CH$_2$)-2' (and analogs thereof; see, e.g., U.S. Pat. No. 8,278,426). The entire contents of each of the foregoing are hereby incorporated herein by reference.

Additional representative U.S. patents and U.S. Patent Publications that teach the preparation of locked nucleic acid nucleotides include, but are not limited to, the following: U.S. Pat. Nos. 6,268,490; 6,525,191; 6,670,461; 6,770,748; 6,794,499; 6,998,484; 7,053,207; 7,034,133; 7,084,125; 7,399,845; 7,427,672; 7,569,686; 7,741,457; 8,022,193; 8,030,467; 8,278,425; 8,278,426; 8,278,283; US 2008/0039618; and US 2009/0012281, the entire contents of each of which are hereby incorporated herein by reference.

Any of the foregoing bicyclic nucleosides can be prepared having one or more stereochemical sugar configurations including for example α-L-ribofuranose and β-D-ribofuranose (see WO 99/14226).

An iRNA agent of the disclosure can also be modified to include one or more constrained ethyl nucleotides. As used herein, a "constrained ethyl nucleotide" or "cEt" is a locked nucleic acid comprising a bicyclic sugar moiety comprising a 4'-CH(CH$_3$)—O-2' bridge (i.e., L in the preceding structure). In one embodiment, a constrained ethyl nucleotide is in the S conformation referred to herein as "S-cEt."

An iRNA of the invention may also include one or more "conformationally restricted nucleotides" ("CRN"). CRN are nucleotide analogs with a linker connecting the C2' and C4' carbons of ribose or the CFB and —C5' carbons of ribose. CRN lock the ribose ring into a stable conformation and increase the hybridization affinity to mRNA. The linker is of sufficient length to place the oxygen in an optimal position for stability and affinity resulting in less ribose ring puckering.

Representative publications that teach the preparation of certain of the above noted CRN include, but are not limited to, US2013/0190383; and WO2013/036868, the entire contents of each of which are hereby incorporated herein by reference.

In some embodiments, an iRNA of the invention comprises one or more monomers that are UNA (unlocked nucleic acid) nucleotides. UNA is unlocked acyclic nucleic acid, wherein any of the bonds of the sugar has been removed, forming an unlocked "sugar" residue. In one example, UNA also encompasses monomer with bonds between C1'-C4' have been removed (i.e. the covalent carbon-oxygen-carbon bond between the C1' and C4' carbons). In another example, the C2'-C3' bond (i.e. the covalent carbon-carbon bond between the C2' and C3' carbons) of the sugar has been removed (see *Nuc. Acids Symp. Series*, 52, 133-134 (2008) and Fluiter et al., *Mol. Biosyst.*, 2009, 10, 1039 hereby incorporated by reference).

Representative U.S. publications that teach the preparation of UNA include, but are not limited to, U.S. Pat. No. 8,314,227; and US2013/0096289; US2013/0011922; and US2011/0313020, the entire contents of each of which are hereby incorporated herein by reference.

Potentially stabilizing modifications to the ends of RNA molecules can include N-(acetylaminocaproyl)-4-hydroxyprolinol (Hyp-C6-NHAc), N-(caproyl-4-hydroxyprolinol (Hyp-C6), N-(acetyl-4-hydroxyprolinol (Hyp-NHAc), thymidine-2'-O-deoxythymidine (ether), N-(aminocaproyl)-4-hydroxyprolinol (Hyp-C6-amino), 2-docosanoyl-uridine-3'-phosphate, inverted 2'-deoxy-modified ribonucleotide, such as inverted dT(idT), inverted dA (idA), and inverted abasic 2'-deoxyribonucleotide (iAb) and others. Disclosure of this modification can be found in WO 2011/005861.

In one example, the 3' or 5' terminal end of a oligonucleotide is linked to an inverted 2'-deoxy-modified ribonucleotide, such as inverted dT(idT), inverted dA (idA), or a inverted abasic 2'-deoxyribonucleotide (iAb). In one particular example, the inverted 2'-deoxy-modified ribonucleotide is linked to the 3'end of an oligonucleotide, such as the 3'-end of a sense strand described herein, where the linking is via a 3'-3' phosphodiester linkage or a 3'-3'-phosphorothioate linkage.

In another example, the 3'-end of a sense strand is linked via a 3'-3'-phosphorothioate linkage to an inverted abasic ribonucleotide (iAb). In another example, the 3'-end of a sense strand is linked via a 3'-3'-phosphorothioate linkage to an inverted dA (idA).

In one particular example, the inverted 2'-deoxy-modified ribonucleotide is linked to the 3'end of an oligonucleotide, such as the 3'-end of a sense strand described herein, where the linking is via a 3'-3' phosphodiester linkage or a 3'-3'-phosphorothioate linkage.

In another example, the 3'-terminal nucleotides of a sense strand is an inverted dA (idA) and is linked to the preceding nucleotide via a 3'-3'-linkage (e.g., 3'-3'-phosphorothioate linkage).

Other modifications of the nucleotides of an iRNA of the invention include a 5' phosphate or 5' phosphate mimic, e.g., a 5'-terminal phosphate or phosphate mimic on the antisense strand of an iRNA. Suitable phosphate mimics are disclosed in, for example US2012/0157511, the entire contents of which are incorporated herein by reference.

A. Modified iRNAs Comprising Motifs of the Invention

In certain aspects of the invention, the double stranded RNA agents of the invention include agents with chemical modifications as disclosed, for example, in WO2013/075035, the entire contents of each of which are incorporated herein by reference. As shown herein and in WO2013/075035, one or more motifs of three identical modifications on three consecutive nucleotides may be introduced into a sense strand or antisense strand of a dsRNAi agent, particularly at or near the cleavage site. In some embodiments, the sense strand and antisense strand of the dsRNAi agent may otherwise be completely modified. The introduction of these motifs interrupts the modification pattern, if present, of the sense or antisense strand. The dsRNAi agent may be optionally conjugated with a GalNAc derivative ligand, for instance on the sense strand.

More specifically, when the sense strand and antisense strand of the double stranded RNA agent are completely modified to have one or more motifs of three identical modifications on three consecutive nucleotides at or near the cleavage site of at least one strand of a dsRNAi agent, the gene silencing activity of the dsRNAi agent was observed.

Accordingly, the invention provides double stranded RNA agents capable of inhibiting the expression of a target gene (i.e., CFB gene) in vivo. The RNAi agent comprises a sense strand and an antisense strand. Each strand of the RNAi agent may be, for example, 17-30 nucleotides in length, 25-30 nucleotides in length, 27-30 nucleotides in length, 19-25 nucleotides in length, 19-23 nucleotides in length, 19-21 nucleotides in length, 21-25 nucleotides in length, or 21-23 nucleotides in length.

The sense strand and antisense strand typically form a duplex double stranded RNA ("dsRNA"), also referred to herein as "dsRNAi agent." The duplex region of a dsRNAi agent may be, for example, the duplex region can be 27-30 nucleotide pairs in length, 19-25 nucleotide pairs in length, 19-23 nucleotide pairs in length, 19-21 nucleotide pairs in length, 21-25 nucleotide pairs in length, or 21-23 nucleotide pairs in length. In another example, the duplex region is selected from 19, 20, 21, 22, 23, 24, 25, 26, and 27 nucleotides in length.

In certain embodiments, the dsRNAi agent may contain one or more overhang regions or capping groups at the 3'-end, 5'-end, or both ends of one or both strands. The overhang can be, independently, 1-6 nucleotides in length, for instance 2-6 nucleotides in length, 1-5 nucleotides in length, 2-5 nucleotides in length, 1-4 nucleotides in length, 2-4 nucleotides in length, 1-3 nucleotides in length, 2-3 nucleotides in length, or 1-2 nucleotides in length. In certain embodiments, the overhang regions can include extended overhang regions as provided above. The overhangs can be the result of one strand being longer than the other, or the result of two strands of the same length being staggered. The overhang can form a mismatch with the target mRNA or it can be complementary to the gene sequences being targeted or can be another sequence. The first and second strands can also be joined, e.g., by additional bases to form a hairpin, or by other non-base linkers.

In certain embodiments, the nucleotides in the overhang region of the dsRNAi agent can each independently be a modified or unmodified nucleotide including, but no limited to 2'-sugar modified, such as, 2'-F, 2'-O-methyl, thymidine (T), 2'-O-methoxyethyl-5-methyluridine (Teo), 2'-O-methoxyethyladenosine (Aeo), 2'-O-methoxyethyl-5-methylcytidine (m5Ceo), and any combinations thereof.

For example, TT can be an overhang sequence for either end on either strand. The overhang can form a mismatch with the target mRNA or it can be complementary to the gene sequences being targeted or can be another sequence.

The 5'- or 3'-overhangs at the sense strand, antisense strand, or both strands of the dsRNAi agent may be phosphorylated. In some embodiments, the overhang region(s) contains two nucleotides having a phosphorothioate between the two nucleotides, where the two nucleotides can be the same or different. In some embodiments, the overhang is present at the 3'-end of the sense strand, antisense strand, or both strands. In some embodiments, this 3'-overhang is present in the antisense strand. In some embodiments, this 3'-overhang is present in the sense strand.

The RNAi agent may contain only a single overhang, which can strengthen the interference activity of the RNAi, without affecting its overall stability. For example, the single-stranded overhang may be located at the 3'-end of the sense strand or, alternatively, at the 3'-end of the antisense strand. The RNAi may also have a blunt end, located at the 5'-end of the antisense strand (i.e., the 3'-end of the sense strand) or vice versa. Generally, the antisense strand of the dsRNAi agent has a nucleotide overhang at the 3'-end, and the 5'-end is blunt. While not wishing to be bound by theory, the asymmetric blunt end at the 5'-end of the antisense strand and 3'-end overhang of the antisense strand favor the guide strand loading into RISC process.

In certain embodiments, the dsRNAi agent is a double blunt-ended of 19 nucleotides in length, wherein the sense strand contains at least one motif of three 2'-F modifications on three consecutive nucleotides at positions 7, 8, and 9 from the 5'end. The antisense strand contains at least one motif of three 2'-O-methyl modifications on three consecutive nucleotides at positions 11, 12, and 13 from the 5'end.

In other embodiments, the dsRNAi agent is a double blunt-ended of 20 nucleotides in length, wherein the sense strand contains at least one motif of three 2'-F modifications on three consecutive nucleotides at positions 8, 9, and 10 from the 5'end. The antisense strand contains at least one motif of three 2'-O-methyl modifications on three consecutive nucleotides at positions 11, 12, and 13 from the 5'end.

In yet other embodiments, the dsRNAi agent is a double blunt-ended of 21 nucleotides in length, wherein the sense strand contains at least one motif of three 2'-F modifications on three consecutive nucleotides at positions 9, 10, and 11 from the 5'end. The antisense strand contains at least one motif of three 2'-O-methyl modifications on three consecutive nucleotides at positions 11, 12, and 13 from the 5'end.

In certain embodiments, the dsRNAi agent comprises a 21 nucleotide sense strand and a 23 nucleotide antisense strand, wherein the sense strand contains at least one motif of three 2'-F modifications on three consecutive nucleotides at positions 9, 10, and 11 from the 5' end; the antisense strand contains at least one motif of three 2'-O-methyl modifications on three consecutive nucleotides at positions 11, 12, and 13 from the 5'end, wherein one end of the RNAi agent is blunt, while the other end comprises a two nucleotide overhang. in one embodiment, the two nucleotide overhang is at the 3'-end of the antisense strand.

When the two nucleotide overhang is at the 3'-end of the antisense strand, there may be two phosphorothioate internucleotide linkages between the terminal three nucleotides, wherein two of the three nucleotides are the overhang nucleotides, and the third nucleotide is a paired nucleotide next to the overhang nucleotide. In one embodiment, the RNAi agent additionally has two phosphorothioate internucleotide linkages between the terminal three nucleotides at both the 5'-end of the sense strand and at the 5'-end of the antisense strand. In certain embodiments, every nucleotide in the sense strand and the antisense strand of the dsRNAi agent, including the nucleotides that are part of the motifs are modified nucleotides. In certain embodiments each residue is independently modified with a 2'-O-methyl or 2'-fluoro, e.g., in an alternating motif. Optionally, the dsRNAi agent further comprises a ligand (such as, GalNAc).

In certain embodiments, the dsRNAi agent comprises a sense and an antisense strand, wherein the sense strand is 25-30 nucleotide residues in length, wherein starting from the 5' terminal nucleotide (position 1) positions 1 to 23 of the first strand comprise at least 8 ribonucleotides; the antisense strand is 36-66 nucleotide residues in length and, starting from the 3' terminal nucleotide, comprises at least 8 ribonucleotides in the positions paired with positions 1-23 of sense strand to form a duplex; wherein at least the 3' terminal nucleotide of antisense strand is unpaired with sense strand, and up to 6 consecutive 3' terminal nucleotides are unpaired with sense strand, thereby forming a 3' single stranded overhang of 1-6 nucleotides; wherein the 5' terminus of antisense strand comprises from 10-30 consecutive nucleotides which are unpaired with sense strand, thereby forming a 10-30 nucleotide single stranded 5' overhang; wherein at least the sense strand 5' terminal and 3' terminal nucleotides are base paired with nucleotides of antisense strand when sense and antisense strands are aligned for maximum complementarity, thereby forming a substantially duplexed region between sense and antisense strands; and antisense strand is sufficiently complementary to a target RNA along at least 19 ribonucleotides of antisense strand length to reduce target gene expression when the double stranded nucleic acid is introduced into a mammalian cell; and wherein the sense strand contains at least one motif of three 2'-F modifications on three consecutive nucleotides, where at least one of the motifs occurs at or near the cleavage site. The antisense strand contains at least one motif of three 2'-O-methyl modifications on three consecutive nucleotides at or near the cleavage site.

In certain embodiments, the dsRNAi agent comprises sense and antisense strands, wherein the dsRNAi agent comprises a first strand having a length which is at least 25 and at most 29 nucleotides and a second strand having a length which is at most 30 nucleotides with at least one motif of three 2'-O-methyl modifications on three consecutive nucleotides at position 11, 12, and 13 from the 5' end; wherein the 3' end of the first strand and the 5' end of the second strand form a blunt end and the second strand is 1-4 nucleotides longer at its 3' end than the first strand, wherein the duplex region which is at least 25 nucleotides in length, and the second strand is sufficiently complementary to a target mRNA along at least 19 nucleotide of the second strand length to reduce target gene expression when the RNAi agent is introduced into a mammalian cell, and wherein Dicer cleavage of the dsRNAi agent results in an siRNA comprising the 3'-end of the second strand, thereby reducing expression of the target gene in the mammal. Optionally, the dsRNAi agent further comprises a ligand.

In certain embodiments, the sense strand of the dsRNAi agent contains at least one motif of three identical modifications on three consecutive nucleotides, where one of the motifs occurs at the cleavage site in the sense strand.

In certain embodiments, the antisense strand of the dsRNAi agent can also contain at least one motif of three identical modifications on three consecutive nucleotides, where one of the motifs occurs at or near the cleavage site in the antisense strand.

For a dsRNAi agent having a duplex region of 19-23 nucleotides in length, the cleavage site of the antisense strand is typically around the 10, 11, and 12 positions from the 5'-end. Thus the motifs of three identical modifications may occur at the 9, 10, and 11 positions; the 10, 11, and 12 positions; the 11, 12, and 13 positions; the 12, 13, and 14 positions; or the 13, 14, and 15 positions of the antisense strand, the count starting from the first nucleotide from the 5'-end of the antisense strand, or, the count starting from the first paired nucleotide within the duplex region from the 5'-end of the antisense strand. The cleavage site in the antisense strand may also change according to the length of the duplex region of the dsRNAi agent from the 5'-end.

The sense strand of the dsRNAi agent may contain at least one motif of three identical modifications on three consecutive nucleotides at the cleavage site of the strand; and the antisense strand may have at least one motif of three identical modifications on three consecutive nucleotides at or near the cleavage site of the strand. When the sense strand and the antisense strand form a dsRNA duplex, the sense strand and the antisense strand can be so aligned that one motif of the three nucleotides on the sense strand and one motif of the three nucleotides on the antisense strand have at least one nucleotide overlap, i.e., at least one of the three nucleotides of the motif in the sense strand forms a base pair with at least one of the three nucleotides of the motif in the antisense strand. Alternatively, at least two nucleotides may overlap, or all three nucleotides may overlap.

In some embodiments, the sense strand of the dsRNAi agent may contain more than one motif of three identical modifications on three consecutive nucleotides. The first motif may occur at or near the cleavage site of the strand and the other motifs may be a wing modification. The term "wing modification" herein refers to a motif occurring at another portion of the strand that is separated from the motif at or near the cleavage site of the same strand. The wing modification is either adjacent to the first motif or is separated by at least one or more nucleotides. When the motifs are immediately adjacent to each other then the chemistries of the motifs are distinct from each other, and when the motifs are separated by one or more nucleotide than the chemistries can be the same or different. Two or more wing modifications may be present. For instance, when two wing modifications are present, each wing modification may occur at one end relative to the first motif which is at or near cleavage site or on either side of the lead motif.

Like the sense strand, the antisense strand of the dsRNAi agent may contain more than one motifs of three identical modifications on three consecutive nucleotides, with at least one of the motifs occurring at or near the cleavage site of the strand. This antisense strand may also contain one or more wing modifications in an alignment similar to the wing modifications that may be present on the sense strand.

In some embodiments, the wing modification on the sense strand or antisense strand of the dsRNAi agent typically does not include the first one or two terminal nucleotides at the 3'-end, 5'-end, or both ends of the strand.

In other embodiments, the wing modification on the sense strand or antisense strand of the dsRNAi agent typically does not include the first one or two paired nucleotides within the duplex region at the 3'-end, 5'-end, or both ends of the strand.

When the sense strand and the antisense strand of the dsRNAi agent each contain at least one wing modification, the wing modifications may fall on the same end of the duplex region, and have an overlap of one, two, or three nucleotides.

When the sense strand and the antisense strand of the dsRNAi agent each contain at least two wing modifications, the sense strand and the antisense strand can be so aligned that two modifications each from one strand fall on one end of the duplex region, having an overlap of one, two, or three nucleotides; two modifications each from one strand fall on the other end of the duplex region, having an overlap of one, two or three nucleotides; two modifications one strand fall on each side of the lead motif, having an overlap of one, two or three nucleotides in the duplex region.

In some embodiments, every nucleotide in the sense strand and antisense strand of the dsRNAi agent, including the nucleotides that are part of the motifs, may be modified. Each nucleotide may be modified with the same or different modification which can include one or more alteration of one or both of the non-linking phosphate oxygens or of one or more of the linking phosphate oxygens; alteration of a constituent of the ribose sugar, e.g., of the 2'-hydroxyl on the ribose sugar; wholesale replacement of the phosphate moiety with "dephospho" linkers; modification or replacement of a naturally occurring base; and replacement or modification of the ribose-phosphate backbone.

As nucleic acids are polymers of subunits, many of the modifications occur at a position which is repeated within a nucleic acid, e.g., a modification of a base, or a phosphate moiety, or a non-linking O of a phosphate moiety. In some cases the modification will occur at all of the subject positions in the nucleic acid but in many cases it will not. By way of example, a modification may only occur at a 3'- or 5' terminal position, may only occur in a terminal region, e.g., at a position on a terminal nucleotide or in the last 2, 3, 4, 5, or 10 nucleotides of a strand. A modification may occur in a double strand region, a single strand region, or in both. A modification may occur only in the double strand region of an RNA or may only occur in a single strand region of a RNA. For example, a phosphorothioate modification at a non-linking O position may only occur at one or both termini, may only occur in a terminal region, e.g., at a position on a terminal nucleotide or in the last 2, 3, 4, 5, or 10 nucleotides of a strand, or may occur in double strand and single strand regions, particularly at termini. The 5'-end or ends can be phosphorylated.

It may be possible, e.g., to enhance stability, to include particular bases in overhangs, or to include modified nucleotides or nucleotide surrogates, in single strand overhangs, e.g., in a 5'- or 3'-overhang, or in both. For example, it can be desirable to include purine nucleotides in overhangs. In some embodiments all or some of the bases in a 3'- or 5'-overhang may be modified, e.g., with a modification described herein. Modifications can include, e.g., the use of modifications at the 2' position of the ribose sugar with modifications that are known in the art, e.g., the use of deoxyribonucleotides, 2'-deoxy-2'-fluoro (2'-F) or 2'-O-methyl modified instead of the ribosugar of the nucleobase, and modifications in the phosphate group, e.g., phosphorothioate modifications. Overhangs need not be homologous with the target sequence.

In some embodiments, each residue of the sense strand and antisense strand is independently modified with LNA, CRN, cET, UNA, HNA, CeNA, 2'-methoxyethyl, 2'-O-methyl, 2'-O-allyl, 2'-C-allyl, 2'-deoxy, 2'-hydroxyl, or 2'-fluoro. The strands can contain more than one modification. In one embodiment, each residue of the sense strand and antisense strand is independently modified with 2'-O-methyl or 2'-fluoro.

At least two different modifications are typically present on the sense strand and antisense strand. Those two modifications may be the 2'-O-methyl or 2'-fluoro modifications, or others.

In certain embodiments, the $N_a$ or $N_b$ comprise modifications of an alternating pattern. The term "alternating motif" as used herein refers to a motif having one or more modifications, each modification occurring on alternating nucleotides of one strand. The alternating nucleotide may refer to one per every other nucleotide or one per every three nucleotides, or a similar pattern. For example, if A, B and C each represent one type of modification to the nucleotide, the alternating motif can be "ABABABABABAB . . . ," "AABBAABBAABB . . . ," "AABAABAABAAB . . . ," "AAABAAABAAAB . . . ," "AAABBBAAABBB . . . ," or "ABCABCABCABC . . . ," etc.

The type of modifications contained in the alternating motif may be the same or different. For example, if A, B, C, D each represent one type of modification on the nucleotide, the alternating pattern, i.e., modifications on every other nucleotide, may be the same, but each of the sense strand or antisense strand can be selected from several possibilities of modifications within the alternating motif such as "ABABAB . . . ", "ACACAC . . . " "BDBDBD . . . " or "CDCDCD . . . ," etc.

In some embodiments, the dsRNAi agent of the invention comprises the modification pattern for the alternating motif on the sense strand relative to the modification pattern for the alternating motif on the antisense strand is shifted. The shift may be such that the modified group of nucleotides of the sense strand corresponds to a differently modified group of nucleotides of the antisense strand and vice versa. For example, the sense strand when paired with the antisense strand in the dsRNA duplex, the alternating motif in the sense strand may start with "ABABAB" from 5' to 3' of the strand and the alternating motif in the antisense strand may start with "BABABA" from 5' to 3' of the strand within the duplex region. As another example, the alternating motif in the sense strand may start with "AABBAABB" from 5' to 3' of the strand and the alternating motif in the antisense strand may start with "BBAABBAA" from 5' to 3' of the strand within the duplex region, so that there is a complete or partial shift of the modification patterns between the sense strand and the antisense strand.

In one particular example, the alternating motif in the sense strand is "ABABAB" from 5' 3' of the strand, where each A is an unmodified ribonucleotide and each B is a 2'-Omethyl modified nucleotide.

In one particular example, the alternating motif in the sense strand is "ABABAB" from 5' 3' of the strand, where each A is an 2'-deoxy-2'-fluoro modified nucleotide and each B is a 2'-Omethyl modified nucleotide.

In another particular example, the alternating motif in the antisense strand is "BABABA" from 3'-5' of the strand, where each A is a 2'-deoxy-2'-fluoro modified nucleotide and each B is a 2'-Omethyl modified nucleotide.

In one particular example, the alternating motif in the sense strand is "ABABAB" from 5' 3' of the strand and the alternating motif in the antisense strand is "BABABA" from 3'-5' of the strand, where each A is an unmodified ribonucleotide and each B is a 2'-Omethyl modified nucleotide.

In one particular example, the alternating motif in the sense strand is "ABABAB" from 5' 3' of the strand and the alternating motif in the antisense strand is "BABABA" from 3'-5' of the strand, where each A is a 2'-deoxy-2'-fluoro modified nucleotide and each B is a 2'-Omethyl modified nucleotide.

In some embodiments, the dsRNAi agent comprises the pattern of the alternating motif of 2'-O-methyl modification and 2'-F modification on the sense strand initially has a shift relative to the pattern of the alternating motif of 2'-O-methyl modification and 2'-F modification on the antisense strand initially, i.e., the 2'-O-methyl modified nucleotide on the sense strand base pairs with a 2'-F modified nucleotide on the antisense strand and vice versa. The 1 position of the sense strand may start with the 2'-F modification, and the 1 position of the antisense strand may start with the 2'-O-methyl modification.

The introduction of one or more motifs of three identical modifications on three consecutive nucleotides to the sense strand or antisense strand interrupts the initial modification pattern present in the sense strand or antisense strand. This interruption of the modification pattern of the sense or antisense strand by introducing one or more motifs of three identical modifications on three consecutive nucleotides to the sense or antisense strand may enhance the gene silencing activity against the target gene.

In some embodiments, when the motif of three identical modifications on three consecutive nucleotides is introduced to any of the strands, the modification of the nucleotide next to the motif is a different modification than the modification of the motif. For example, the portion of the sequence containing the motif is " . . . $N_a$YYY$N_b$ . . . ," where "Y" represents the modification of the motif of three identical modifications on three consecutive nucleotide, and "$N_a$" and "$N_b$" represent a modification to the nucleotide next to the motif "YYY" that is different than the modification of Y, and where $N_a$ and $N_b$ can be the same or different modifications. Alternatively, $N_a$ or $N_b$ may be present or absent when there is a wing modification present.

The iRNA may further comprise at least one phosphorothioate or methylphosphonate internucleotide linkage. The phosphorothioate or methylphosphonate internucleotide linkage modification may occur on any nucleotide of the sense strand, antisense strand, or both strands in any position of the strand. For instance, the internucleotide linkage modification may occur on every nucleotide on the sense strand or antisense strand; each internucleotide linkage modification may occur in an alternating pattern on the sense strand or antisense strand; or the sense strand or antisense strand may contain both internucleotide linkage modifications in an alternating pattern. The alternating pattern of the internucleotide linkage modification on the sense strand may be the same or different from the antisense strand, and the alternating pattern of the internucleotide linkage modification on the sense strand may have a shift relative to the alternating pattern of the internucleotide linkage modification on the antisense strand. In one embodiment, a double-stranded RNAi agent comprises 6-8 phosphorothioate internucleotide linkages. In some embodiments, the antisense strand comprises two phosphorothioate internucleotide linkages at the 5'-end and two phosphorothioate internucleotide linkages at the 3'-end, and the sense strand comprises at least two phosphorothioate internucleotide linkages at either the 5'-end or the 3'-end.

In some embodiments, the dsRNAi agent comprises a phosphorothioate or methylphosphonate internucleotide linkage modification in the overhang region. For example, the overhang region may contain two nucleotides having a phosphorothioate or methylphosphonate internucleotide linkage between the two nucleotides. Internucleotide linkage modifications also may be made to link the overhang nucleotides with the terminal paired nucleotides within the duplex region. For example, at least 2, 3, 4, or all the overhang nucleotides may be linked through phosphorothioate or methylphosphonate internucleotide linkage, and optionally, there may be additional phosphorothioate or methylphosphonate internucleotide linkages linking the overhang nucleotide with a paired nucleotide that is next to the overhang nucleotide. For instance, there may be at least two phosphorothioate internucleotide linkages between the terminal three nucleotides, in which two of the three nucleotides are overhang nucleotides, and the third is a paired nucleotide next to the overhang nucleotide. These terminal three nucleotides may be at the 3'-end of the antisense strand, the 3'-end of the sense strand, the 5'-end of the antisense strand, or the 5'end of the antisense strand.

In some embodiments, the 2-nucleotide overhang is at the 3'-end of the antisense strand, and there are two phosphorothioate internucleotide linkages between the terminal three nucleotides, wherein two of the three nucleotides are the overhang nucleotides, and the third nucleotide is a paired nucleotide next to the overhang nucleotide. Optionally, the dsRNAi agent may additionally have two phosphorothioate internucleotide linkages between the terminal three nucleotides at both the 5'-end of the sense strand and at the 5'-end of the antisense strand.

In one embodiment, the dsRNAi agent comprises mismatch(es) with the target, within the duplex, or combinations thereof. The mismatch may occur in the overhang region or the duplex region. The base pair may be ranked on the basis of their propensity to promote dissociation or melting (e.g., on the free energy of association or dissociation of a particular pairing, the simplest approach is to examine the pairs on an individual pair basis, though next neighbor or similar analysis can also be used). In terms of promoting dissociation: A:U is preferred over G:C; G:U is preferred over G:C; and I:C is preferred over G:C (I=inosine). Mismatches, e.g., non-canonical or other than canonical pairings (as described elsewhere herein) are preferred over canonical (A:T, A:U, G:C) pairings; and pairings which include a universal base are preferred over canonical pairings.

In certain embodiments, the dsRNAi agent comprises at least one of the first 1, 2, 3, 4, or 5 base pairs within the duplex regions from the 5'-end of the antisense strand independently selected from the group of: A:U, G:U, I:C, and mismatched pairs, e.g., non-canonical or other than canonical pairings or pairings which include a universal base, to promote the dissociation of the antisense strand at the 5'-end of the duplex.

In certain embodiments, the nucleotide at the 1 position within the duplex region from the 5'-end in the antisense strand is selected from A, dA, dU, U, and dT. Alternatively, at least one of the first 1, 2, or 3 base pair within the duplex region from the 5'-end of the antisense strand is an AU base pair. For example, the first base pair within the duplex region from the 5'-end of the antisense strand is an AU base pair.

In other embodiments, the nucleotide at the 3'-end of the sense strand is deoxythimidine (dT) or the nucleotide at the 3'-end of the antisense strand is deoxythimidine (dT). For example, there is a short sequence of deoxythimidine nucleotides, for example, two dT nucleotides on the 3'-end of the sense, antisense strand, or both strands.

In certain embodiments, the sense strand sequence may be represented by formula (I):

5'$n_p$-$N_a$-(XXX)$_i$-$N_b$-YYY-$N_b$-(ZZZ)$_j$-$N_a$-$n_q$3'  (I)

wherein:
i and j are each independently 0 or 1;
p and q are each independently 0-6;
each $N_a$ independently represents an oligonucleotide sequence comprising 0-25 modified nucleotides, each sequence comprising at least two differently modified nucleotides;
each $N_b$ independently represents an oligonucleotide sequence comprising 0-10 modified nucleotides;
each $n_p$ and $n_q$ independently represent an overhang nucleotide;
wherein Nb and Y do not have the same modification; and XXX, YYY, and ZZZ each independently represent one motif of three identical modifications on three consecutive nucleotides. In one embodiment, YYY is all 2'-F modified nucleotides.

In some embodiments, the $N_a$ or $N_b$ comprises modifications of alternating pattern.

In some embodiments, the YYY motif occurs at or near the cleavage site of the sense strand. For example, when the dsRNAi agent has a duplex region of 17-23 nucleotides in length, the YYY motif can occur at or the vicinity of the cleavage site (e.g.: can occur at positions 6, 7, 8; 7, 8, 9; 8, 9, 10; 9, 10, 11; 10, 11, 12; or 11, 12, 13) of the sense strand, the count starting from the first nucleotide, from the 5'-end; or optionally, the count starting at the first paired nucleotide within the duplex region, from the 5'-end.

In one embodiment, i is 1 and j is 0, or i is 0 and j is 1, or both i and j are 1. The sense strand can therefore be represented by the following formulas:

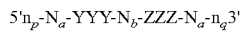     (Ib);

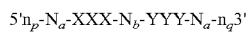     (Ic); or

     (Id).

When the sense strand is represented by formula (Ib), $N_b$ represents an oligonucleotide sequence comprising 0-10, 0-7, 0-5, 0-4, 0-2, or 0 modified nucleotides. Each $N_a$ independently can represent an oligonucleotide sequence comprising 2-20, 2-15, or 2-10 modified nucleotides.

When the sense strand is represented as formula (Ic), $N_b$ represents an oligonucleotide sequence comprising 0-10, 0-7, 0-10, 0-7, 0-5, 0-4, 0-2, or 0 modified nucleotides. Each $N_a$ can independently represent an oligonucleotide sequence comprising 2-20, 2-15, or 2-10 modified nucleotides.

When the sense strand is represented as formula (Id), each $N_b$ independently represents an oligonucleotide sequence comprising 0-10, 0-7, 0-5, 0-4, 0-2, or 0 modified nucleotides. In one embodiment, $N_b$ is 0, 1, 2, 3, 4, 5, or 6. Each $N_a$ can independently represent an oligonucleotide sequence comprising 2-20, 2-15, or 2-10 modified nucleotides.

Each of X, Y and Z may be the same or different from each other.

In other embodiments, i is 0 and j is 0, and the sense strand may be represented by the formula:

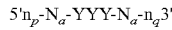     (Ia).

When the sense strand is represented by formula (Ia), each $N_a$ independently can represent an oligonucleotide sequence comprising 2-20, 2-15, or 2-10 modified nucleotides.

In one embodiment, the antisense strand sequence of the RNAi may be represented by formula (II):

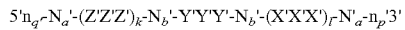     (II)

wherein:
k and l are each independently 0 or 1;
p' and q' are each independently 0-6;
each $N_a'$ independently represents an oligonucleotide sequence comprising 0-25 modified nucleotides, each sequence comprising at least two differently modified nucleotides;
each $N_b'$ independently represents an oligonucleotide sequence comprising 0-10 modified nucleotides;
each $n_p'$ and $n_q'$ independently represent an overhang nucleotide;
wherein $N_b'$ and Y' do not have the same modification; and X'X'X', Y'Y'Y', and Z'Z'Z' each independently represent one motif of three identical modifications on three consecutive nucleotides.

In some embodiments, the $N_a'$ or $N_b'$ comprises modifications of alternating pattern.

The Y'Y'Y' motif occurs at or near the cleavage site of the antisense strand. For example, when the dsRNAi agent has a duplex region of 17-23 nucleotides in length, the Y'Y'Y' motif can occur at positions 9, 10, 11; 10, 11, 12; 11, 12, 13; 12, 13, 14; or 13, 14, 15 of the antisense strand, with the count starting from the first nucleotide, from the 5'-end; or optionally, the count starting at the first paired nucleotide within the duplex region, from the 5'-end. In one embodiment, the Y'Y'Y' motif occurs at positions 11, 12, 13.

In certain embodiments, Y'Y'Y' motif is all 2'-OMe modified nucleotides.

In certain embodiments, k is 1 and l is 0, or k is 0 and l is 1, or both k and l are 1.

The antisense strand can therefore be represented by the following formulas:

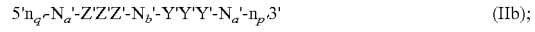     (IIb);

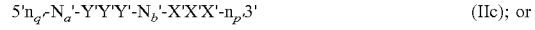     (IIc); or

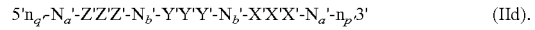     (IId).

When the antisense strand is represented by formula (IIb), $N_b'$ represents an oligonucleotide sequence comprising 0-10, 0-7, 0-10, 0-7, 0-5, 0-4, 0-2, or 0 modified nucleotides. Each $N_a'$ independently represents an oligonucleotide sequence comprising 2-20, 2-15, or 2-10 modified nucleotides.

When the antisense strand is represented as formula (IIc), $N_b'$ represents an oligonucleotide sequence comprising 0-10, 0-7, 0-10, 0-7, 0-5, 0-4, 0-2, or 0 modified nucleotides. Each $N_a'$ independently represents an oligonucleotide sequence comprising 2-20, 2-15, or 2-10 modified nucleotides.

When the antisense strand is represented as formula (IId), each $N_b'$ independently represents an oligonucleotide sequence comprising 0-10, 0-7, 0-10, 0-7, 0-5, 0-4, 0-2, or 0 modified nucleotides. Each $N_a'$ independently represents an oligonucleotide sequence comprising 2-20, 2-15, or 2-10 modified nucleotides. In one embodiment, $N_b$ is 0, 1, 2, 3, 4, 5, or 6.

In other embodiments, k is 0 and l is 0 and the antisense strand may be represented by the formula:

     (Ia).

When the antisense strand is represented as formula (IIa), each $N_a'$ independently represents an oligonucleotide sequence comprising 2-20, 2-15, or 2-10 modified nucleotides.

Each of X', Y' and Z' may be the same or different from each other.

Each nucleotide of the sense strand and antisense strand may be independently modified with LNA, CRN, UNA, cEt, glycol nucleic acid (GNA), hexitol nucleic acid (HNA) CeNA, 2'-methoxyethyl, 2'-O-methyl, 2'-O-allyl, 2'-C-allyl, 2'-hydroxyl, or 2'-fluoro. For example, each nucleotide of the sense strand and antisense strand is independently modified with 2'-O-methyl or 2'-fluoro. Each X, Y, Z, X', Y', and Z', in particular, may represent a 2'-O-methyl modification or a 2'-fluoro modification.

In some embodiments, the sense strand of the dsRNAi agent may contain YYY motif occurring at 9, 10, and 11 positions of the strand when the duplex region is 21 nt, the count starting from the first nucleotide from the 5'-end, or optionally, the count starting at the first paired nucleotide within the duplex region, from the 5'-end; and Y represents 2'-F modification. The sense strand may additionally contain XXX motif or ZZZ motifs as wing modifications at the opposite end of the duplex region; and XXX and ZZZ each independently represents a 2'-OMe modification or 2'-F modification.

In some embodiments the antisense strand may contain Y'Y'Y' motif occurring at positions 11, 12, 13 of the strand, the count starting from the first nucleotide from the 5'-end, or optionally, the count starting at the first paired nucleotide within the duplex region, from the 5'-end; and Y' represents 2'-O-methyl modification. The antisense strand may additionally contain X'X'X' motif or Z'Z'Z' motifs as wing modifications at the opposite end of the duplex region; and X'X'X' and Z'Z'Z' each independently represents a 2'-OMe modification or 2'-F modification.

The sense strand represented by any one of the above formulas (Ia), (Ib), (Ic), and (Id) forms a duplex with an antisense strand being represented by any one of formulas (IIa), (IIb), (IIc), and (IId), respectively.

Accordingly, the dsRNAi agents for use in the methods of the invention may comprise a sense strand and an antisense strand, each strand having 14 to 30 nucleotides, the iRNA duplex represented by formula (III):

sense: 5'$n_p$-$N_a$-(XXX)$_i$-$N_b$-YYY-$N_b$-(ZZZ)-$N_a$-$n_q$3' antisense: 3'$n_p$'-$N_a$'-(X'X'X')$_k$-$N_b$'-Y'Y'Y'-$N_b$'-(Z'Z'Z')$_l$-$N_a$'-$n_q$'5'       (III)

wherein:

i, j, k, and l are each independently 0 or 1;

p, p', q, and q' are each independently 0-6;

each $N_a$ and $N_a$' independently represents an oligonucleotide sequence comprising 0-25 modified nucleotides, each sequence comprising at least two differently modified nucleotides;

each $N_b$ and $N_b$' independently represents an oligonucleotide sequence comprising 0-10 modified nucleotides;

wherein each $n_p$', $n_p$, $n_q$', and $n_q$, each of which may or may not be present, independently represents an overhang nucleotide; and XXX, YYY, ZZZ, X'X'X', Y'Y'Y', and Z'Z'Z' each independently represent one motif of three identical modifications on three consecutive nucleotides.

In one embodiment, i is 0 and j is 0; or i is 1 and j is 0; or i is 0 and j is 1; or both i and j are 0; or both i and j are 1. In another embodiment, k is 0 and l is 0; or k is 1 and l is 0; k is 0 and l is 1; or both k and l are 0; or both k and l are 1.

Exemplary combinations of the sense strand and antisense strand forming an iRNA duplex include the formulas below:

5'$n_p$-$N_a$-YYY-$N_a$-$n_q$3'

3'$n_p$'-$N_a$'-Y'Y'Y'-$N_a$'$n_q$'5'     (IIIa)

5'$n_p$-$N_a$-YYY-$N_b$-ZZZ-$N_a$-$n_q$3'

3'$n_p$'-$N_a$'-Y'Y'Y'-$N_b$'-Z'Z'Z'-$N_a$'$n_q$'5'     (IIIb)

5'$n_p$-$N_a$-XXX-$N_b$-YYY-$N_a$-$n_q$3'

3'$n_p$'-$N_a$'-X'X'X'-$N_b$'-Y'Y'Y'-$N_a$'-$n_q$'5'     (IIIc)

5'$n_p$-$N_a$-XXX-$N_b$-YYY-$N_b$-ZZZ-$N_a$-$n_q$3'

3'$n_p$'-$N_a$'-X'X'X'-$N_b$'-Y'Y'Y'-$N_b$'-Z'Z'Z'-$N_a$-$n_q$'5'     (IIId)

When the dsRNAi agent is represented by formula (IIIa), each $N_a$ independently represents an oligonucleotide sequence comprising 2-20, 2-15, or 2-10 modified nucleotides.

When the dsRNAi agent is represented by formula (IIIb), each $N_b$ independently represents an oligonucleotide sequence comprising 1-10, 1-7, 1-5, or 1-4 modified nucleotides. Each $N_a$ independently represents an oligonucleotide sequence comprising 2-20, 2-15, or 2-10 modified nucleotides.

When the dsRNAi agent is represented as formula (IIIc), each $N_b$, $N_b$' independently represents an oligonucleotide sequence comprising 0-10, 0-7, 0-10, 0-7, 0-5, 0-4, 0-2, or 0 modified nucleotides. Each $N_a$ independently represents an oligonucleotide sequence comprising 2-20, 2-15, or 2-10 modified nucleotides.

When the dsRNAi agent is represented as formula (IIId), each $N_b$, $N_b$' independently represents an oligonucleotide sequence comprising 0-10, 0-7, 0-10, 0-7, 0-5, 0-4, 0-2, or 0 modified nucleotides. Each $N_a$, $N_a$' independently represents an oligonucleotide sequence comprising 2-20, 2-15, or 2-10 modified nucleotides. Each of $N_a$, $N_a$', $N_b$, and $N_b$' independently comprises modifications of alternating pattern.

Each of X, Y, and Z in formulas (III), (IIIa), (IIIb), (IIIc), and (IIId) may be the same or different from each other.

When the dsRNAi agent is represented by formula (III), (IIIa), (IIIb), (IIIc), and (IIId), at least one of the Y nucleotides may form a base pair with one of the Y' nucleotides. Alternatively, at least two of the Y nucleotides form base pairs with the corresponding Y' nucleotides; or all three of the Y nucleotides all form base pairs with the corresponding Y' nucleotides.

When the dsRNAi agent is represented by formula (IIIb) or (IIId), at least one of the Z nucleotides may form a base pair with one of the Z' nucleotides. Alternatively, at least two of the Z nucleotides form base pairs with the corresponding Z' nucleotides; or all three of the Z nucleotides all form base pairs with the corresponding Z' nucleotides.

When the dsRNAi agent is represented as formula (IIIc) or (IIId), at least one of the X nucleotides may form a base pair with one of the X' nucleotides. Alternatively, at least two of the X nucleotides form base pairs with the corresponding X' nucleotides; or all three of the X nucleotides all form base pairs with the corresponding X' nucleotides.

In certain embodiments, the modification on the Y nucleotide is different than the modification on the Y' nucleotide, the modification on the Z nucleotide is different than the modification on the Z' nucleotide, or the modification on the X nucleotide is different than the modification on the X' nucleotide.

In certain embodiments, when the dsRNAi agent is represented by formula (IIId), the $N_a$ modifications are 2'-O-methyl or 2'-fluoro modifications. In other embodiments, when the RNAi agent is represented by formula (IIId), the $N_a$ modifications are 2'-O-methyl or 2'-fluoro modifications and $n_p$'>0 and at least one $n_p$' is linked to a neighboring nucleotide a via phosphorothioate linkage. In yet other embodiments, when the RNAi agent is represented by formula (IIId), the $N_a$ modifications are 2'-O-methyl or 2'-fluoro modifications, $n_p$'>0 and at least one $n_p$' is linked to a neighboring nucleotide via phosphorothioate linkage, and the sense strand is conjugated to one or more GalNAc derivatives attached through a bivalent or trivalent branched linker (described below). In other embodiments, when the RNAi agent is represented by formula (IIId), the $N_a$ modifications are 2'-O-methyl or 2'-fluoro modifications, $n_p$'>0 and at least one $n_p'$ is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In some embodiments, when the dsRNAi agent is represented by formula (IIIa), the $N_a$ modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In some embodiments, the dsRNAi agent is a multimer containing at least two duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In some embodiments, the dsRNAi agent is a multimer containing three, four, five, six, or more duplexes represented by formula (III), (IIIa), (IIIb), (IIIc), and (IIId), wherein the duplexes are connected by a linker. The linker can be cleavable or non-cleavable. Optionally, the multimer further comprises a ligand. Each of the duplexes can target the same gene or two different genes; or each of the duplexes can target same gene at two different target sites.

In one embodiment, two dsRNAi agents represented by at least one of formulas (III), (IIIa), (IIIb), (IIIc), and (IIId) are linked to each other at the 5' end, and one or both of the 3' ends, and are optionally conjugated to a ligand. Each of the agents can target the same gene or two different genes; or each of the agents can target same gene at two different target sites.

In certain embodiments, an RNAi agent of the invention may contain a low number of nucleotides containing a 2'-fluoro modification, e.g., 10 or fewer nucleotides with 2'-fluoro modification. For example, the RNAi agent may contain 10, 9, 8, 7, 6, 5, 4, 3, 2, 1 or 0 nucleotides with a 2'-fluoro modification. In a specific embodiment, the RNAi agent of the invention contains 10 nucleotides with a 2'-fluoro modification, e.g., 4 nucleotides with a 2'-fluoro modification in the sense strand and 6 nucleotides with a 2'-fluoro modification in the antisense strand. In another specific embodiment, the RNAi agent of the invention contains 6 nucleotides with a 2'-fluoro modification, e.g., 4 nucleotides with a 2'-fluoro modification in the sense strand and 2 nucleotides with a 2'-fluoro modification in the antisense strand.

In other embodiments, an RNAi agent of the invention may contain an ultra low number of nucleotides containing a 2'-fluoro modification, e.g., 2 or fewer nucleotides containing a 2'-fluoro modification. For example, the RNAi agent may contain 2, 1 of 0 nucleotides with a 2'-fluoro modification. In a specific embodiment, the RNAi agent may contain 2 nucleotides with a 2'-fluoro modification, e.g., 0 nucleotides with a 2-fluoro modification in the sense strand and 2 nucleotides with a 2'-fluoro modification in the antisense strand.

Various publications describe multimeric iRNAs that can be used in the methods of the invention. Such publications include WO2007/091269, U.S. Pat. No. 7,858,769, WO2010/141511, WO2007/117686, WO2009/014887, and WO2011/031520 the entire contents of each of which are hereby incorporated herein by reference.

In certain embodiments, the compositions and methods of the disclosure include a vinyl phosphonate (VP) modification of an RNAi agent as described herein. In exemplary embodiments, a 5'-vinyl phosphonate modified nucleotide of the disclosure has the structure:

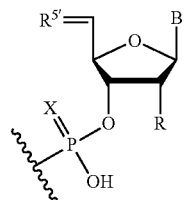

wherein X is O or S;
R is hydrogen, hydroxy, fluoro, or $C_{1-20}$alkoxy (e.g., methoxy or n-hexadecyloxy);
$R^{5'}$ is =C(H)—P(O)(OH)$_2$ and the double bond between the C5' carbon and $R^{5'}$ is in the E or Z orientation (e.g., E orientation); and
B is a nucleobase or a modified nucleobase, optionally where B is adenine, guanine, cytosine, thymine, or uracil.

In one embodiment, $R^{5'}$ is =C(H)—P(O)(OH)$_2$ and the double bond between the C5' carbon and R5' is in the E orientation. In another embodiment, R is methoxy and $R^{5'}$ is =C(H)—P(O)(OH)$_2$ and the double bond between the C5' carbon and R5' is in the E orientation. In another embodiment, X is S, R is methoxy, and $R^{5'}$ is =C(H)—P(O)(OH)$_2$ and the double bond between the C5' carbon and R5' is in the E orientation.

A vinyl phosphonate of the instant disclosure may be attached to either the antisense or the sense strand of a dsRNA of the disclosure. In certain embodiments, a on phosphonate of the instant disclosure is attached to the antisense strand of a dsRNA, optionally at the 5' end of the antisense strand of the dsRNA.

Vinyl phosphonate modifications are also contemplated for the compositions and methods of the instant disclosure. An exemplary vinyl phosphonate structure includes the preceding structure, where R5' is =C(H)—OP(O)(OH)2 and the double bond between the C5' carbon and R5' is in the E or Z orientation (e.g., E orientation).

As described in more detail below, the iRNA that contains conjugations of one or more carbohydrate moieties to an iRNA can optimize one or more properties of the iRNA. In many cases, the carbohydrate moiety will be attached to a modified subunit of the iRNA. For example, the ribose sugar of one or more ribonucleotide subunits of an iRNA can be replaced with another moiety, e.g., a non-carbohydrate (such as, cyclic) carrier to which is attached a carbohydrate ligand. A ribonucleotide subunit in which the ribose sugar of the subunit has been so replaced is referred to herein as a ribose replacement modification subunit (RRMS). A cyclic carrier may be a carbocyclic ring system, i.e., all ring atoms are carbon atoms, or a heterocyclic ring system, i.e., one or more ring atoms may be a heteroatom, e.g., nitrogen, oxygen, sulfur. The cyclic carrier may be a monocyclic ring system, or may contain two or more rings, e.g. fused rings. The cyclic carrier may be a fully saturated ring system, or it may contain one or more double bonds.

The ligand may be attached to the polynucleotide via a carrier. The carriers include (i) at least one "backbone attachment point," such as, two "backbone attachment points" and (ii) at least one "tethering attachment point." A "backbone attachment point" as used herein refers to a functional group, e.g. a hydroxyl group, or generally, a bond available for, and that is suitable for incorporation of the carrier into the backbone, e.g., the phosphate, or modified phosphate, e.g., sulfur containing, backbone, of a ribonucleic acid. A "tethering attachment point" (TAP) in some embodiments refers to a constituent ring atom of the cyclic carrier, e.g., a carbon atom or a heteroatom (distinct from an atom which provides a backbone attachment point), that connects a selected moiety. The moiety can be, e.g., a carbohydrate, e.g. monosaccharide, disaccharide, trisaccharide, tetrasaccharide, oligosaccharide, or polysaccharide. Optionally, the selected moiety is connected by an intervening tether to the cyclic carrier. Thus, the cyclic carrier will often include a functional group, e.g., an amino group, or generally, provide a bond, that is suitable for incorporation or tethering of another chemical entity, e.g., a ligand to the constituent ring.

The iRNA may be conjugated to a ligand via a carrier, wherein the carrier can be cyclic group or acyclic group. In some embodiments, the cyclic group is selected from pyrrolidinyl, pyrazolinyl, pyrazolidinyl, imidazolinyl, imidazolidinyl, piperidinyl, piperazinyl, [1,3]dioxolane, oxazolidinyl, isoxazolidinyl, morpholinyl, thiazolidinyl, isothiazolidinyl, quinoxalinyl, pyridazinonyl, tetrahydrofuryl, and decalin. In some embodiments, the acyclic group is a serinol backbone or diethanolamine backbone.

i. Thermally Destabilizing Modifications

In certain embodiments, a dsRNA molecule can be optimized for RNA interference by incorporating thermally destabilizing modifications in the seed region of the antisense strand. As used herein "seed region" means at positions 2-9 of the 5'-end of the referenced strand or at positions 2-8 of the 5'-end of the referenced strand. For example, thermally destabilizing modifications can be incorporated in the seed region of the antisense strand to reduce or inhibit off-target gene silencing.

The term "thermally destabilizing modification(s)" includes modification(s) that would result with a dsRNA with a lower overall melting temperature (Tm) than the Tm of the dsRNA without having such modification(s). For example, the thermally destabilizing modification(s) can decrease the Tm of the dsRNA by 1-4° C., such as one, two, three or four degrees Celcius. And, the term "thermally destabilizing nucleotide" refers to a nucleotide containing one or more thermally destabilizing modifications.

It has been discovered that dsRNAs with an antisense strand comprising at least one thermally destabilizing modification of the duplex within the first 9 nucleotide positions, counting from the 5' end, of the antisense strand have reduced off-target gene silencing activity. Accordingly, in some embodiments, the antisense strand comprises at least one (e.g., one, two, three, four, five or more) thermally destabilizing modification of the duplex within the first 9 nucleotide positions of the 5' region of the antisense strand. In some embodiments, one or more thermally destabilizing modification(s) of the duplex is/are located in positions 2-9, such as, positions 4-8, from the 5'-end of the antisense strand. In some further embodiments, the thermally destabilizing modification(s) of the duplex is/are located at position 6, 7 or 8 from the 5'-end of the antisense strand. In still some further embodiments, the thermally destabilizing modification of the duplex is located at position 7 from the 5'-end of the antisense strand. In some embodiments, the thermally destabilizing modification of the duplex is located at position 2, 3, 4, 5 or 9 from the 5'-end of the antisense strand.

The thermally destabilizing modifications can include, but are not limited to, abasic modification; mismatch with the opposing nucleotide in the opposing strand; and sugar modification such as 2'-deoxy modification, acyclic nucleotide, e.g., unlocked nucleic acids (UNA) or glycol nucleic acid (GNA); and 2'-5'-linked ribonucleotides ("3'-RNA").

An iRNA agent comprises a sense strand and an antisense strand, each strand having 14 to 40 nucleotides. The RNAi agent may be represented by formula (L):

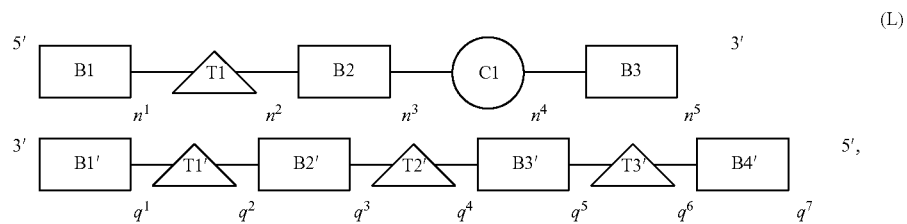

(L)

In formula (L), B1, B2, B3, B1', B2', B3', and B4' each are independently a nucleotide containing a modification selected from the group consisting of 2'-O-alkyl, 2'-substituted alkoxy, 2'-substituted alkyl, 2'-halo, ENA, and BNA/LNA. In one embodiment, B1, B2, B3, B1', B2', B3', and B4' each contain 2'-OMe modifications. In one embodiment, B1, B2, B3, B1', B2', B3', and B4' each contain 2'-OMe or 2'-F modifications. In one embodiment, at least one of B1, B2, B3, B1', B2', B3', and B4' contain 2'-O—N-methylacetamido (2'-O-NMA) modification.

C1 is a thermally destabilizing nucleotide placed at a site opposite to the seed region of the antisense strand (i.e., at positions 2-8 of the 5'-end of the antisense strand or at positions 2-9 of the 5'-end of the referenced strand). For example, C1 is at a position of the sense strand that pairs with a nucleotide at positions 2-8 of the 5'-end of the antisense strand. In one example, C1 is at position 15 from the 5'-end of the sense strand. C1 nucleotide bears the thermally destabilizing modification which can include abasic modification; mismatch with the opposing nucleotide in the duplex; and sugar modification such as 2'-deoxy modification or acyclic nucleotide e.g., unlocked nucleic acids (UNA) or glycerol nucleic acid (GNA). In one embodiment, C1 has thermally destabilizing modification selected from the group consisting of: i) mismatch with the opposing nucleotide in the antisense strand; ii) abasic modification selected from the group consisting of:

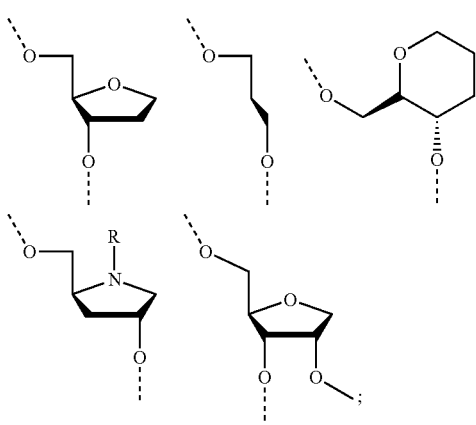

and iii) sugar modification selected from the group consisting of:

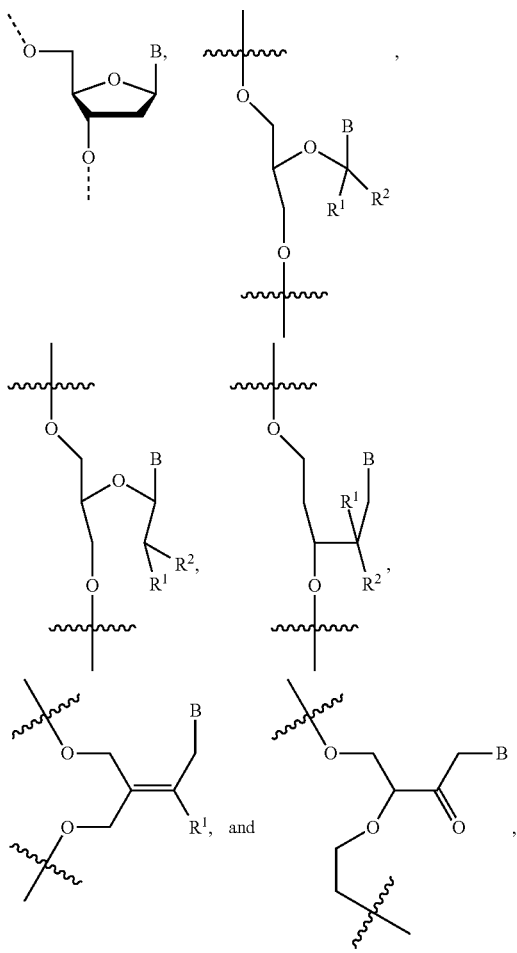

wherein B is a modified or unmodified nucleobase, $R^1$ and $R^2$ independently are H, halogen, $OR_3$, or alkyl; and $R_3$ is H, alkyl, cycloalkyl, aryl, aralkyl, heteroaryl or sugar. In one embodiment, the thermally destabilizing modification in C1 is a mismatch selected from the group consisting of G:G, G:A, G:U, G:T, A:A, A:C, C:C, C:U, C:T, U:U, T:T, and U:T; and optionally, at least one nucleobase in the mismatch pair is a 2'-deoxy nucleobase. In one example, the thermally destabilizing modification in C1 is GNA or

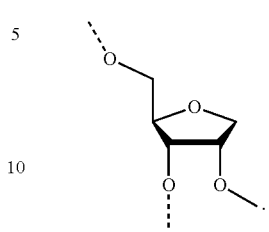

T1, T1', T2', and T3' each independently represent a nucleotide comprising a modification providing the nucleotide a steric bulk that is less or equal to the steric bulk of a 2'-OMe modification. A steric bulk refers to the sum of steric effects of a modification. Methods for determining steric effects of a modification of a nucleotide are known to one skilled in the art. The modification can be at the 2' position of a ribose sugar of the nucleotide, or a modification to a non-ribose nucleotide, acyclic nucleotide, or the backbone of the nucleotide that is similar or equivalent to the 2' position of the ribose sugar, and provides the nucleotide a steric bulk that is less than or equal to the steric bulk of a 2'-OMe modification. For example, T1, T1', T2', and T3' are each independently selected from DNA, RNA, LNA, 2'-F, and 2'-F-5'-methyl. In one embodiment, T1 is DNA. In one embodiment, T1' is DNA, RNA or LNA. In one embodiment, T2' is DNA or RNA. In one embodiment, T3' is DNA or RNA.

$n^1$, $n^3$, and $q^1$ are independently 4 to 15 nucleotides in length.

$n^5$, $q^3$, and $q^7$ are independently 1-6 nucleotide(s) in length.

$n^4$, $q^2$, and $q^6$ are independently 1-3 nucleotide(s) in length; alternatively, $n^4$ is 0.

$q^5$ is independently 0-10 nucleotide(s) in length.

$n^2$ and $q^4$ are independently 0-3 nucleotide(s) in length. Alternatively, $n^4$ is 0-3 nucleotide(s) in length.

In one embodiment, $n^4$ can be 0. In one example, $n^4$ is 0, and $q^2$ and $q^6$ are 1. In another example, $n^4$ is 0, and $q^2$ and $q^6$ are 1, with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, $n^4$, $q^2$, and $q^6$ are each 1.

In one embodiment, $n^2$, $n^4$, $q^2$, $q^4$, and q are each 1.

In one embodiment, C1 is at position 14-17 of the 5'-end of the sense strand, when the sense strand is 19-22 nucleotides in length, and $n^4$ is 1. In one embodiment, C1 is at position 15 of the 5'-end of the sense strand In one embodiment, T3' starts at position 2 from the 5' end of the antisense strand. In one example, T3' is at position 2 from the 5' end of the antisense strand and $q^6$ is equal to 1.

In one embodiment, T1' starts at position 14 from the 5' end of the antisense strand. In one example, T1' is at position 14 from the 5' end of the antisense strand and $q^2$ is equal to 1.

In an exemplary embodiment, T3' starts from position 2 from the 5' end of the antisense strand and T1' starts from position 14 from the 5' end of the antisense strand. In one example, T3' starts from position 2 from the 5' end of the antisense strand and $q^6$ is equal to 1 and T1' starts from position 14 from the 5' end of the antisense strand and $q^2$ is equal to 1.

In one embodiment, T1' and T3' are separated by 11 nucleotides in length (i.e. not counting the T1' and T3' nucleotides).

In one embodiment, T1' is at position 14 from the 5' end of the antisense strand. In one example, T1' is at position 14 from the 5' end of the antisense strand and $q^2$ is equal to 1, and the modification at the 2' position or positions in a non-ribose, acyclic or backbone that provide less steric bulk than a 2'-OMe ribose.

In one embodiment, T3' is at position 2 from the 5' end of the antisense strand. In one example, T3' is at position 2 from the 5' end of the antisense strand and $q^6$ is equal to 1, and the modification at the 2' position or positions in a non-ribose, acyclic or backbone that provide less than or equal to steric bulk than a 2'-OMe ribose.

In one embodiment, T1 is at the cleavage site of the sense strand. In one example, T1 is at position 11 from the 5' end of the sense strand, when the sense strand is 19-22 nucleotides in length, and $n^2$ is 1. In an exemplary embodiment, T1 is at the cleavage site of the sense strand at position 11 from the 5' end of the sense strand, when the sense strand is 19-22 nucleotides in length, and $n^2$ is 1, In one embodiment, T2' starts at position 6 from the 5' end of the antisense strand. In one example, T2' is at positions 6-10 from the 5' end of the antisense strand, and $q^4$ is 1.

In an exemplary embodiment, T1 is at the cleavage site of the sense strand, for instance, at position 11 from the 5' end of the sense strand, when the sense strand is 19-22 nucleotides in length, and $n^2$ is 1; T1' is at position 14 from the 5' end of the antisense strand, and $q^2$ is equal to 1, and the modification to T1' is at the 2' position of a ribose sugar or at positions in a non-ribose, acyclic or backbone that provide less steric bulk than a 2'-OMe ribose; T2' is at positions 6-10 from the 5' end of the antisense strand, and $q^4$ is 1; and T3' is at position 2 from the 5' end of the antisense strand, and $q^6$ is equal to 1, and the modification to T3' is at the 2' position or at positions in a non-ribose, acyclic or backbone that provide less than or equal to steric bulk than a 2'-OMe ribose.

In one embodiment, T2' starts at position 8 from the 5' end of the antisense strand. In one example, T2' starts at position 8 from the 5' end of the antisense strand, and $q^4$ is 2.

In one embodiment, T2' starts at position 9 from the 5' end of the antisense strand. In one example, T2' is at position 9 from the 5' end of the antisense strand, and $q^4$ is 1.

In one embodiment, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 6, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 7, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1.

In one embodiment, B1 is 2'-OMe or 2'-F, $n^1$ is 6, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 7, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 1, B3' is 2'-OMe or 2'-F, $q^5$ is 6, T3' is 2'-F, $q^6$ is 1, B4' is 2'-OMe, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 5, T2' is 2'-F, $q^4$ is 1, B3' is 2'-OMe or 2'-F, $q^5$ is 5, T3' is 2'-F, $q^6$ is 1, B4' is 2'-OMe, and $q^7$ is 1; optionally with at least 2 additional TT at the 3'-end of the antisense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 5, T2' is 2'-F, $q^4$ is 1, B3' is 2'-OMe or 2'-F, $q^5$ is 5, T3' is 2'-F, $q^6$ is 1, B4' is 2'-OMe, and $q^7$ is 1;

optionally with at least 2 additional TT at the 3'-end of the antisense strand; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within positions 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within positions 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand).

The RNAi agent can comprise a phosphorus-containing group at the 5'-end of the sense strand or antisense strand. The 5'-end phosphorus-containing group can be 5'-end phosphate (5'-P), 5'-end phosphorothioate (5'-PS), 5'-end phosphorodithioate (5'-$PS_2$), 5'-end vinylphosphonate (5'-VP), 5'-end methylphosphonate (MePhos), or 5'-deoxy-5'-C-malonyl

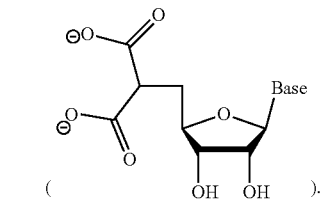

When the 5'-end phosphorus-containing group is 5'-end vinylphosphonate (5'-VP), the 5'-VP can be either 5'-E-VP isomer (i.e., trans-vinylphosphonate,

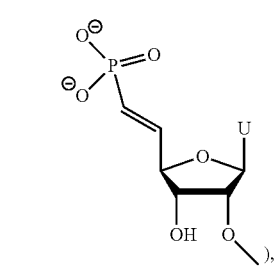

5'-Z-VP isomer (i.e., cis-vinylphosphonate,

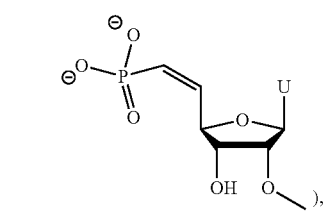

or mixtures thereof.

In one embodiment, the RNAi agent comprises a phosphorus-containing group at the 5'-end of the sense strand. In one embodiment, the RNAi agent comprises a phosphorus-containing group at the 5'-end of the antisense strand.

In one embodiment, the RNAi agent comprises a 5'-P. In one embodiment, the RNAi agent comprises a 5'-P in the antisense strand.

In one embodiment, the RNAi agent comprises a 5'-PS. In one embodiment, the RNAi agent comprises a 5'-PS in the antisense strand.

In one embodiment, the RNAi agent comprises a 5'-VP. In one embodiment, the RNAi agent comprises a 5'-VP in the antisense strand. In one embodiment, the RNAi agent comprises a 5'-E-VP in the antisense strand. In one embodiment, the RNAi agent comprises a 5'-Z-VP in the antisense strand.

In one embodiment, the RNAi agent comprises a 5'-$PS_2$. In one embodiment, the RNAi agent comprises a 5'-$PS_2$ in the antisense strand.

In one embodiment, the RNAi agent comprises a 5'-$PS_2$. In one embodiment, the RNAi agent comprises a 5'-deoxy-5'-C-malonyl in the antisense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1. The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^5$ is 1, B4' is 2'-OMe, and $q^7$ is 1. The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^5$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The dsRNA agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1. The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, 10 $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The dsRNAi RNA agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1. The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^d$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1. The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP. The 5'-VP may be 5'-E-VP, 5'-Z-VP, or combination thereof.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS and a targeting ligand. In one embodiment, the 5'-PS is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP (e.g., a 5'-E-VP, 5'-Z-VP, or combination thereof), and a targeting ligand.

In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$ and a targeting ligand. In one embodiment, the 5'-PS$_2$ is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-OMe, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl and a targeting ligand. In one embodiment, the 5'-deoxy-5'-C-malonyl is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-PS and a targeting ligand. In one embodiment, the 5'-PS is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-VP (e.g., a 5'-E-VP, 5'-Z-VP, or combination thereof) and a targeting ligand. In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-PS$_2$ and a targeting ligand. In one embodiment, the 5'-PS$_2$ is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-OMe, and $q^7$ is 1; with two phosphorothioate internucleotide linkage modifications within position 1-5 of the sense strand (counting from the 5'-end), and two phosphorothioate internucleotide linkage modifications at positions 1 and 2 and two phosphorothioate internucleotide linkage modifications within positions 18-23 of the antisense strand (counting from the 5'-end). The RNAi agent also comprises a 5'-deoxy-5'-C-malonyl and a targeting ligand. In one embodiment, the 5'-deoxy-5'-C-malonyl is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS and a targeting ligand. In one embodiment, the 5'-PS is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP (e.g., a 5'-E-VP, 5'-Z-VP, or combination thereof) and a targeting ligand. In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$ and a targeting ligand. In one embodiment, the 5'-PS$_2$ is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, T2' is 2'-F, $q^4$ is 2, B3' is 2'-OMe or 2'-F, $q^5$ is 5, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl and a targeting ligand. In one embodiment, the 5'-deoxy-5'-C-malonyl is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-P and a targeting ligand. In one embodiment, the 5'-P is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS and a targeting ligand. In one embodiment, the 5'-PS is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-VP (e.g., a 5'-E-VP, 5'-Z-VP, or combination thereof) and a targeting ligand. In one embodiment, the 5'-VP is at the 5'-end of the antisense strand, and the targeting ligand is at the 3'-end of the sense strand.

In one embodiment, B1 is 2'-OMe or 2'-F, $n^1$ is 8, T1 is 2'F, $n^2$ is 3, B2 is 2'-OMe, $n^3$ is 7, $n^4$ is 0, B3 is 2'-OMe, $n^5$ is 3, B1' is 2'-OMe or 2'-F, $q^1$ is 9, T1' is 2'-F, $q^2$ is 1, B2' is 2'-OMe or 2'-F, $q^3$ is 4, $q^4$ is 0, B3' is 2'-OMe or 2'-F, $q^5$ is 7, T3' is 2'-F, $q^6$ is 1, B4' is 2'-F, and $q^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-PS$_2$ and a targeting ligand. In one embodiment, the 5'-PS$_2$ is at the 5'-end of the antisense strand, and the targeting ligand is at the 3'-end of the sense strand.

In one embodiment, B1 is 2'-OMe or 2'-F, n$^1$ is 8, T1 is 2'F, n$^2$ is 3, B2 is 2'-OMe, n$^3$ is 7, n$^4$ is 0, B3 is 2'-OMe, n$^5$ is 3, B1' is 2'-OMe or 2'-F, q$^1$ is 9, T1' is 2'-F, q$^2$ is 1, B2' is 2'-OMe or 2'-F, q$^3$ is 4, q$^4$ is 0, B3' is 2'-OMe or 2'-F, q$^5$ is 7, T3' is 2'-F, q$^6$ is 1, B4' is 2'-F, and q$^7$ is 1; with two phosphorothioate internucleotide linkage modifications within position 1-5 of the sense strand (counting from the 5'-end of the sense strand), and two phosphorothioate internucleotide linkage modifications at positions 1 and 2 and two phosphorothioate internucleotide linkage modifications within positions 18-23 of the antisense strand (counting from the 5'-end of the antisense strand). The RNAi agent also comprises a 5'-deoxy-5'-C-malonyl and a targeting ligand. In one embodiment, the 5'-deoxy-5'-C-malonyl is at the 5'-end of the antisense strand, and the targeting ligand is at the 3'-end of the sense strand.

In a particular embodiment, an RNAi agent of the present invention comprises:
(a) a sense strand having:
  (i) a length of 21 nucleotides;
  (ii) an ASGPR ligand attached to the 3'-end, wherein said ASGPR ligand comprises three GalNAc derivatives attached through a trivalent branched linker; and
  (iii) 2'-F modifications at positions 1, 3, 5, 7, 9 to 11, 13, 17, 19, and 21, and 2'-OMe modifications at positions 2, 4, 6, 8, 12, 14 to 16, 18, and 20 (counting from the 5' end); and
(b) an antisense strand having:
  (i) a length of 23 nucleotides;
  (ii) 2'-OMe modifications at positions 1, 3, 5, 9, 11 to 13, 15, 17, 19, 21, and 23, and 2'F modifications at positions 2, 4, 6 to 8, 10, 14, 16, 18, 20, and 22 (counting from the 5' end); and
  (iii) phosphorothioate internucleotide linkages between nucleotide positions 21 and 22, and between nucleotide positions 22 and 23 (counting from the 5' end);
wherein the dsRNA agents have a two nucleotide overhang at the 3'-end of the antisense strand, and a blunt end at the 5'-end of the antisense strand.

In another particular embodiment, an RNAi agent of the present invention comprises:
(a) a sense strand having:
(i) a length of 21 nucleotides;
(ii) an ASGPR ligand attached to the 3'-end, wherein said ASGPR ligand comprises three GalNAc derivatives attached through a trivalent branched linker;
  (iii) 2'-F modifications at positions 1, 3, 5, 7, 9 to 11, 13, 15, 17, 19, and 21, and 2'-OMe modifications at positions 2, 4, 6, 8, 12, 14, 16, 18, and 20 (counting from the 5' end); and
  (iv) phosphorothioate internucleotide linkages between nucleotide positions 1 and 2, and between nucleotide positions 2 and 3 (counting from the 5' end);
and
(b) an antisense strand having:
  (i) a length of 23 nucleotides;
  (ii) 2'-OMe modifications at positions 1, 3, 5, 7, 9, 11 to 13, 15, 17, 19, and 21 to 23, and 2'F modifications at positions 2, 4, 6, 8, 10, 14, 16, 18, and 20 (counting from the 5' end); and
  (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);
wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
  (i) a length of 21 nucleotides;
  (ii) an ASGPR ligand attached to the 3'-end, wherein said ASGPR ligand comprises three GalNAc derivatives attached through a trivalent branched linker;
    (iii) 2'-OMe modifications at positions 1 to 6, 8, 10, and 12 to 21, 2'-F modifications at positions 7, and 9, and a deoxy-nucleotide (e.g. dT) at position 11 (counting from the 5' end); and
    (iv) phosphorothioate internucleotide linkages between nucleotide positions 1 and 2, and between nucleotide positions 2 and 3 (counting from the 5' end);
and
(b) an antisense strand having:
  (i) a length of 23 nucleotides;
  (ii) 2'-OMe modifications at positions 1, 3, 7, 9, 11, 13, 15, 17, and 19 to 23, and 2'-F modifications at positions 2, 4 to 6, 8, 10, 12, 14, 16, and 18 (counting from the 5' end); and
  (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);
wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
  (i) a length of 21 nucleotides;
  (ii) an ASGPR ligand attached to the 3'-end, wherein said ASGPR ligand comprises three GalNAc derivatives attached through a trivalent branched linker;
    (iii) 2'-OMe modifications at positions 1 to 6, 8, 10, 12, 14, and 16 to 21, and 2'-F modifications at positions 7, 9, 11, 13, and 15; and
    (iv) phosphorothioate internucleotide linkages between nucleotide positions 1 and 2, and between nucleotide positions 2 and 3 (counting from the 5' end);
and
(b) an antisense strand having:
  (i) a length of 23 nucleotides;
  (ii) 2'-OMe modifications at positions 1, 5, 7, 9, 11, 13, 15, 17, 19, and 21 to 23, and 2'-F modifications at positions 2 to 4, 6, 8, 10, 12, 14, 16, 18, and 20 (counting from the 5' end); and
  (iii) phosphorothioate internucleotide linkages between nucleotide positions 1 and 2, between nucleotide positions 2 and 3, between nucleotide positions 21 and 22, and between nucleotide positions 22 and 23 (counting from the 5' end);
wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
(i) a length of 21 nucleotides;

(ii) an ASGPR ligand attached to the 3'-end, wherein said ASGPR ligand comprises three GalNAc derivatives attached through a trivalent branched linker;
(iii) 2'-OMe modifications at positions 1 to 9, and 12 to 21, and 2'-F modifications at positions 10, and 11; and
(iv) phosphorothioate internucleotide linkages between nucleotide positions 1 and 2, and between nucleotide positions 2 and 3 (counting from the 5' end); and (b) an antisense strand having:
(i) a length of 23 nucleotides;
(ii) 2'-OMe modifications at positions 1, 3, 5, 7, 9, 11 to 13, 15, 17, 19, and 21 to 23, and 2'-F modifications at positions 2, 4, 6, 8, 10, 14, 16, 18, and 20 (counting from the 5' end); and
(iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
(i) a length of 21 nucleotides;
(ii) an ASGPR ligand attached to the 3'-end, wherein said ASGPR ligand comprises three GalNAc derivatives attached through a trivalent branched linker;
(iii) 2'-F modifications at positions 1, 3, 5, 7, 9 to 11, and 13, and 2'-OMe modifications at positions 2, 4, 6, 8, 12, and 14 to 21; and
(iv) phosphorothioate internucleotide linkages between nucleotide positions 1 and 2, and between nucleotide positions 2 and 3 (counting from the 5' end); and (b) an antisense strand having:
(i) a length of 23 nucleotides;
(ii) 2'-OMe modifications at positions 1, 3, 5 to 7, 9, 11 to 13, 15, 17 to 19, and 21 to 23, and 2'-F modifications at positions 2, 4, 8, 10, 14, 16, and 20 (counting from the 5' end); and
(iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
(i) a length of 21 nucleotides;
(ii) an ASGPR ligand attached to the 3'-end, wherein said ASGPR ligand comprises three GalNAc derivatives attached through a trivalent branched linker;
(iii) 2'-OMe modifications at positions 1, 2, 4, 6, 8, 12, 14, 15, 17, and 19 to 21, and 2'-F modifications at positions 3, 5, 7, 9 to 11, 13, 16, and 18; and
(iv) phosphorothioate internucleotide linkages between nucleotide positions 1 and 2, and between nucleotide positions 2 and 3 (counting from the 5' end); and (b) an antisense strand having:
(i) a length of 25 nucleotides;
(ii) 2'-OMe modifications at positions 1, 4, 6, 7, 9, 11 to 13, 15, 17, and 19 to 23, 2'-F modifications at positions 2, 3, 5, 8, 10, 14, 16, and 18, and desoxy-nucleotides (e.g. dT) at positions 24 and 25 (counting from the 5' end); and
(iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a four nucleotide overhang at the 3'-end of the antisense strand, and a blunt end at the 5'-end of the antisense strand.

In another particular embodiment, a RNAi agent of the present invention comprises:
(a) a sense strand having:
(i) a length of 21 nucleotides;
(ii) an ASGPR ligand attached to the 3'-end, wherein said ASGPR ligand comprises three GalNAc derivatives attached through a trivalent branched linker;
(iii) 2'-OMe modifications at positions 1 to 6, 8, and 12 to 21, and 2'-F modifications at positions 7, and 9 to 11; and
(iv) phosphorothioate internucleotide linkages between nucleotide positions 1 and 2, and between nucleotide positions 2 and 3 (counting from the 5' end); and (b) an antisense strand having:
(i) a length of 23 nucleotides;
(ii) 2'-OMe modifications at positions 1, 3 to 5, 7, 8, 10 to 13, 15, and 17 to 23, and 2'-F modifications at positions 2, 6, 9, 14, and 16 (counting from the 5' end); and
(iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two nucleotide overhang at the 3'-end of the antisense strand, and a blunt end at the 5'-end of the antisense strand.

In another particular embodiment, a RNAi agent of the present invention comprises:
(a) a sense strand having:
(i) a length of 21 nucleotides;
(ii) an ASGPR ligand attached to the 3'-end, wherein said ASGPR ligand comprises three GalNAc derivatives attached through a trivalent branched linker;
(iii) 2'-OMe modifications at positions 1 to 6, 8, and 12 to 21, and 2'-F modifications at positions 7, and 9 to 11; and
(iv) phosphorothioate internucleotide linkages between nucleotide positions 1 and 2, and between nucleotide positions 2 and 3 (counting from the 5' end); and (b) an antisense strand having:
(i) a length of 23 nucleotides;
(ii) 2'-OMe modifications at positions 1, 3 to 5, 7, 10 to 13, 15, and 17 to 23, and 2'-F modifications at positions 2, 6, 8, 9, 14, and 16 (counting from the 5' end); and
(iii) phosphorothioate internucleotide linkages between nucleotide positions 1 and 2, between nucleotide positions 2 and 3, between nucleotide positions 21 and 22, and between nucleotide positions 22 and 23 (counting from the 5' end);

wherein the RNAi agents have a two nucleotide overhang at the 3'-end of the antisense strand, and a blunt end at the 5'-end of the antisense strand.

In another particular embodiment, a RNAi agent of the present invention comprises:

(a) a sense strand having:
  (i) a length of 19 nucleotides;
  (ii) an ASGPR ligand attached to the 3'-end, wherein said ASGPR ligand comprises three GalNAc derivatives attached through a trivalent branched linker;
  (iii) 2'-OMe modifications at positions 1 to 4, 6, and 10 to 19, and 2'-F modifications at positions 5, and 7 to 9; and
  (iv) phosphorothioate internucleotide linkages between nucleotide positions 1 and 2, and between nucleotide positions 2 and 3 (counting from the 5' end);

and (b) an antisense strand having:
  (i) a length of 21 nucleotides;
  (ii) 2'-OMe modifications at positions 1, 3 to 5, 7, 10 to 13, 15, and 17 to 21, and 2'-F modifications at positions 2, 6, 8, 9, 14, and 16 (counting from the 5' end); and
  (iii) phosphorothioate internucleotide linkages between nucleotide positions 1 and 2, between nucleotide positions 2 and 3, between nucleotide positions 19 and 20, and between nucleotide positions 20 and 21 (counting from the 5' end);

wherein the RNAi agents have a two nucleotide overhang at the 3'-end of the antisense strand, and a blunt end at the 5'-end of the antisense strand.

In certain embodiments, the iRNA for use in the methods of the invention is an agent selected from agents listed in any one of Tables 2-3. These agents may further comprise a ligand.

III. iRNAs Conjugated to Ligands

Another modification of the RNA of an iRNA of the invention involves chemically linking to the iRNA one or more ligands, moieties or conjugates that enhance the activity, cellular distribution, or cellular uptake of the iRNA e.g., into a cell. Such moieties include but are not limited to lipid moieties such as a cholesterol moiety (Letsinger et al., *Proc. Natl. Acid. Sci. USA,* 1989, 86: 6553-6556). In other embodiments, the ligand is cholic acid (Manoharan et al., *Biorg. Med. Chem. Let.,* 1994, 4:1053-1060), a thioether, e.g., beryl-S-tritylthiol (Manoharan et al., *Ann. N.Y. Acad. Sci.,* 1992, 660:306-309; Manoharan et al., *Biorg. Med. Chem. Let.,* 1993, 3:2765-2770), a thiocholesterol (Oberhauser et al., *Nucl. Acids Res.,* 1992, 20:533-538), an aliphatic chain, e.g., dodecandiol or undecyl residues (Saison-Behmoaras et al., *EMBO J,* 1991, 10:1111-1118; Kabanov et al., *FEBS Lett.,* 1990, 259:327-330; Svinarchuk et al., *Biochimie,* 1993, 75:49-54), a phospholipid, e.g., di-hexadecyl-rac-glycerol or triethyl-ammonium 1,2-di-O-hexadecyl-rac-glycero-3-phosphonate (Manoharan et al., *Tetrahedron Lett.,* 1995, 36:3651-3654; Shea et al., *Nucl. Acids Res.,* 1990, 18:3777-3783), a polyamine or a polyethylene glycol chain (Manoharan et al., *Nucleosides & Nucleotides,* 1995, 14:969-973), or adamantane acetic acid (Manoharan et al., *Tetrahedron Lett.,* 1995, 36:3651-3654), a palmityl moiety (Mishra et al., *Biochim. Biophys. Acta,* 1995, 1264:229-237), or an octadecylamine or hexylamino-carbonyloxycholesterol moiety (Crooke et al., *J. Pharmacol. Exp. Ther.,* 1996, 277:923-937).

In certain embodiments, a ligand alters the distribution, targeting, or lifetime of an iRNA agent into which it is incorporated. In certain embodiments a ligand provides an enhanced affinity for a selected target, e.g., molecule, cell or cell type, compartment, e.g., a cellular or organ compartment, tissue, organ or region of the body, as, e.g., compared to a species absent such a ligand. In some embodiments, ligands do not take part in duplex pairing in a duplexed nucleic acid.

Ligands can include a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin, N-acetylglucosamine, N-acetylgalactosamine, or hyaluronic acid); or a lipid. The ligand can also be a recombinant or synthetic molecule, such as a synthetic polymer, e.g., a synthetic polyamino acid. Examples of polyamino acids include polyamino acid is a polylysine (PLL), poly L-aspartic acid, poly L-glutamic acid, styrene-maleic acid anhydride copolymer, poly(L-lactide-co-glycolide) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly (2-ethylacrylic acid), N-isopropylacrylamide polymers, or polyphosphazene. Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Ligands can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-glucosamine multivalent mannose, multivalent fucose, glycosylated polyaminoacids, multivalent galactose, transferrin, bisphosphonate, polyglutamate, polyaspartate, a lipid, cholesterol, a steroid, bile acid, folate, vitamin B12, vitamin A, biotin, or an RGD peptide or RGD peptide mimetic. In certain embodiments, the ligand is a multivalent galactose, e.g., an N-acetyl-galactosamine.

Other examples of ligands include dyes, intercalating agents (e.g. acridines), cross-linkers (e.g. psoralene, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g., cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, borneol, menthol, 1,3-propanediol, heptadecyl group, palmitic acid, myristic acid, O3-(oleoyl) lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, [MPEG]$_2$, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a hepatic cell. Ligands can also include hormones and hormone receptors. They can also include non-peptidic species, such as lipids, lectins, carbohydrates, vitamins, cofactors, multivalent lactose, multivalent galactose, N-acetyl-galactosamine, N-acetyl-glucosamine multivalent mannose, or multivalent fucose. The ligand can be, for example, a lipopolysaccharide, an activator of p38 MAP kinase, or an activator of NF-κB.

The ligand can be a substance, e.g., a drug, which can increase the uptake of the iRNA agent into the cell, for example, by disrupting the cell's cytoskeleton, e.g., by disrupting the cell's microtubules, microfilaments, or intermediate filaments. The drug can be, for example, taxol, vincristine, vinblastine, cytochalasin, nocodazole, japlakinolide, latrunculin A, phalloidin, swinholide A, indanocine, or myoservin.

In some embodiments, a ligand attached to an iRNA as described herein acts as a pharmacokinetic modulator (PK modulator). PK modulators include lipophiles, bile acids, steroids, phospholipid analogues, peptides, protein binding agents, PEG, vitamins, etc. Exemplary PK modulators include, but are not limited to, cholesterol, fatty acids, cholic acid, lithocholic acid, dialkylglycerides, diacylglyceride, phospholipids, sphingolipids, naproxen, ibuprofen, vitamin E, biotin. Oligonucleotides that comprise a number of phosphorothioate linkages are also known to bind to serum protein, thus short oligonucleotides, e.g., oligonucleotides of about 5 bases, 10 bases, 15 bases, or 20 bases, comprising multiple of phosphorothioate linkages in the backbone are also amenable to the present invention as ligands (e.g. as PK modulating ligands). In addition, aptamers that bind serum components (e.g. serum proteins) are also suitable for use as PK modulating ligands in the embodiments described herein.

Ligand-conjugated iRNAs of the invention may be synthesized by the use of an oligonucleotide that bears a pendant reactive functionality, such as that derived from the attachment of a linking molecule onto the oligonucleotide (described below). This reactive oligonucleotide may be reacted directly with commercially-available ligands, ligands that are synthesized bearing any of a variety of protecting groups, or ligands that have a linking moiety attached thereto.

The oligonucleotides used in the conjugates of the present invention may be conveniently and routinely made through the well-known technique of solid-phase synthesis. Equipment for such synthesis is sold by several vendors including, for example, Applied Biosystems® (Foster City, Calif.). Any other methods for such synthesis known in the art may additionally or alternatively be employed. It is also known to use similar techniques to prepare other oligonucleotides, such as the phosphorothioates and alkylated derivatives.

In the ligand-conjugated iRNAs and ligand-molecule bearing sequence-specific linked nucleosides of the present invention, the oligonucleotides and oligonucleosides may be assembled on a suitable DNA synthesizer utilizing standard nucleotide or nucleoside precursors, or nucleotide or nucleoside conjugate precursors that already bear the linking moiety, ligand-nucleotide or nucleoside-conjugate precursors that already bear the ligand molecule, or non-nucleoside ligand-bearing building blocks.

When using nucleotide-conjugate precursors that already bear a linking moiety, the synthesis of the sequence-specific linked nucleosides is typically completed, and the ligand molecule is then reacted with the linking moiety to form the ligand-conjugated oligonucleotide. In some embodiments, the oligonucleotides or linked nucleosides of the present invention are synthesized by an automated synthesizer using phosphoramidites derived from ligand-nucleoside conjugates in addition to the standard phosphoramidites and non-standard phosphoramidites that are commercially available and routinely used in oligonucleotide synthesis.

A. Lipid Conjugates

In certain embodiments, the ligand or conjugate is a lipid or lipid-based molecule. Such a lipid or lipid-based molecule may bind a serum protein, e.g., human serum albumin (HSA). An HSA binding ligand allows for distribution of the conjugate to a target tissue, e.g., a non-kidney target tissue of the body. For example, the target tissue can be the liver, including parenchymal cells of the liver. Other molecules that can bind HSA can also be used as ligands. For example, naproxen or aspirin can be used. A lipid or lipid-based ligand can (a) increase resistance to degradation of the conjugate, (b) increase targeting or transport into a target cell or cell membrane, or (c) can be used to adjust binding to a serum protein, e.g., HSA.

A lipid based ligand can be used to inhibit, e.g., control the binding of the conjugate to a target tissue. For example, a lipid or lipid-based ligand that binds to HSA more strongly will be less likely to be targeted to the kidney and therefore less likely to be cleared from the body. A lipid or lipid-based ligand that binds to HSA less strongly can be used to target the conjugate to the kidney.

In certain embodiments, the lipid based ligand binds HSA. In one embodiment, it binds HSA with a sufficient affinity such that the conjugate will be distributed to a non-kidney tissue. However, it is preferred that the affinity not be so strong that the HSA-ligand binding cannot be reversed.

In other embodiments, the lipid based ligand binds HSA weakly or not at all, such that the conjugate will be distributed to the kidney. Other moieties that target to kidney cells can also be used in place of, or in addition to, the lipid based ligand.

In another aspect, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include are B vitamin, e.g., folic acid, B12, riboflavin, biotin, pyridoxal or other vitamins or nutrients taken up by target cells such as liver cells. Also included are HSA and low density lipoprotein (LDL).

B. Cell Permeation Agents

In another aspect, the ligand is a cell-permeation agent, such as, a helical cell-permeation agent. In one embodiment, the agent is amphipathic. An exemplary agent is a peptide such as tat or antennapedia. If the agent is a peptide, it can be modified, including a peptidylmimetic, invertomers, non-peptide or pseudo-peptide linkages, and use of D-amino acids. In one embodiment, the helical agent is an alpha-helical agent, for example, having a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The attachment of peptide and peptidomimetics to iRNA agents can affect pharmacokinetic distribution of the iRNA, such as by enhancing cellular recognition and absorption. The peptide or peptidomimetic moiety can be about 5-50 amino acids long, e.g., about 5, 10, 15, 20, 25, 30, 35, 40, 45, or 50 amino acids long.

A peptide or peptidomimetic can be, for example, a cell permeation peptide, cationic peptide, amphipathic peptide, or hydrophobic peptide (e.g., consisting primarily of Tyr, Trp, or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVLLALLAP (SEQ ID NO: 15). An RFGF analogue (e.g., amino acid sequence AALLPVL-LAAP (SEQ ID NO:16) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ (SEQ ID NO: 17) and the Drosophila Antennapedia protein (RQIKIWFQNRRMKWKK (SEQ ID NO: 18) have been found to be capable of functioning as delivery peptides. A peptide or peptidomimetic can be encoded by a random sequence of DNA, such as a peptide identified from a phage-display library, or one-bead-one-compound (OBOC) combinatorial library (Lam et al., Nature, 354:82-84, 1991). Examples of a peptide or peptidomimetic tethered to a dsRNA agent via an incorporated monomer unit for cell targeting purposes is an arginine-glycine-aspartic acid (RGD)-peptide, or RGD mimic. A peptide moiety can range in length from about 5 amino acids to about 40 amino acids. The peptide moieties can have a structural modification, such as to increase stability or direct conformational properties. Any of the structural modifications described below can be utilized.

An RGD peptide for use in the compositions and methods of the invention may be linear or cyclic, and may be modified, e.g., glycosylated or methylated, to facilitate targeting to a specific tissue(s). RGD-containing peptides and peptidomimetics may include D-amino acids, as well as synthetic RGD mimics. In addition to RGD, one can use other moieties that target the integrin ligand, such as, PECAM-1 or VEGF.

A "cell permeation peptide" is capable of permeating a cell, e.g., a microbial cell, such as a bacterial or fungal cell, or a mammalian cell, such as a human cell. A microbial cell-permeating peptide can be, for example, an α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen (Simeoni et al., Nucl. Acids Res. 31:2717-2724, 2003).

C. Carbohydrate Conjugates

In some embodiments of the compositions and methods of the invention, an iRNA further comprises a carbohydrate. The carbohydrate conjugated iRNA is advantageous for the in vivo delivery of nucleic acids, as well as compositions suitable for in vivo therapeutic use, as described herein. As used herein, "carbohydrate" refers to a compound which is either a carbohydrate per se made up of one or more monosaccharide units having at least 6 carbon atoms (which can be linear, branched or cyclic) with an oxygen, nitrogen or sulfur atom bonded to each carbon atom; or a compound having as a part thereof a carbohydrate moiety made up of one or more monosaccharide units each having at least six carbon atoms (which can be linear, branched or cyclic), with an oxygen, nitrogen or sulfur atom bonded to each carbon atom. Representative carbohydrates include the sugars (mono-, di-, tri-, and oligosaccharides containing from about 4, 5, 6, 7, 8, or 9 monosaccharide units), and polysaccharides such as starches, glycogen, cellulose and polysaccharide gums. Specific monosaccharides include C5 and above (e.g., C5, C6, C7, or C8) sugars; di- and trisaccharides include sugars having two or three monosaccharide units (e.g., C5, C6, C7, or C8).

In certain embodiments, a carbohydrate conjugate for use in the compositions and methods of the invention is a monosaccharide.

In certain embodiments, the monosaccharide is an N-acetylgalactosamine (GalNAc). GalNAc conjugates, which comprise one or more N-acetylgalactosamine (GalNAc) derivatives, are described, for example, in U.S. Pat. No. 8,106,022, the entire content of which is hereby incorporated herein by reference. In some embodiments, the GalNAc conjugate serves as a ligand that targets the iRNA to particular cells. In some embodiments, the GalNAc conjugate targets the iRNA to liver cells, e.g., by serving as a ligand for the asialoglycoprotein receptor of liver cells (e.g., hepatocytes).

In some embodiments, the carbohydrate conjugate comprises one or more GalNAc derivatives. The GalNAc derivatives may be attached via a linker, e.g., a bivalent or trivalent branched linker. In some embodiments the GalNAc conjugate is conjugated to the 3' end of the sense strand. In some embodiments, the GalNAc conjugate is conjugated to the iRNA agent (e.g., to the 3' end of the sense strand) via a linker, e.g., a linker as described herein. In some embodiments the GalNAc conjugate is conjugated to the 5' end of the sense strand. In some embodiments, the GalNAc conjugate is conjugated to the iRNA agent (e.g., to the 5' end of the sense strand) via a linker, e.g., a linker as described herein.

In certain embodiments of the invention, the GalNAc or GalNAc derivative is attached to an iRNA agent of the invention via a monovalent linker. In some embodiments, the GalNAc or GalNAc derivative is attached to an iRNA agent of the invention via a bivalent linker. In yet other embodiments of the invention, the GalNAc or GalNAc derivative is attached to an iRNA agent of the invention via a trivalent linker. In other embodiments of the invention, the GalNAc or GalNAc derivative is attached to an iRNA agent of the invention via a tetravalent linker.

In certain embodiments, the double stranded RNAi agents of the invention comprise one GalNAc or GalNAc derivative attached to the iRNA agent. In certain embodiments, the double stranded RNAi agents of the invention comprise a plurality (e.g., 2, 3, 4, 5, or 6) GalNAc or GalNAc derivatives, each independently attached to a plurality of nucleotides of the double stranded RNAi agent through a plurality of monovalent linkers.

In some embodiments, for example, when the two strands of an iRNA agent of the invention are part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker. The hairpin loop may also be formed by an extended overhang in one strand of the duplex.

In some embodiments, for example, when the two strands of an iRNA agent are part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker. The hairpin loop may also be formed by an extended overhang in one strand of the duplex.

In one embodiment, a carbohydrate conjugate for use in the compositions and methods of the invention is selected from the group consisting of:

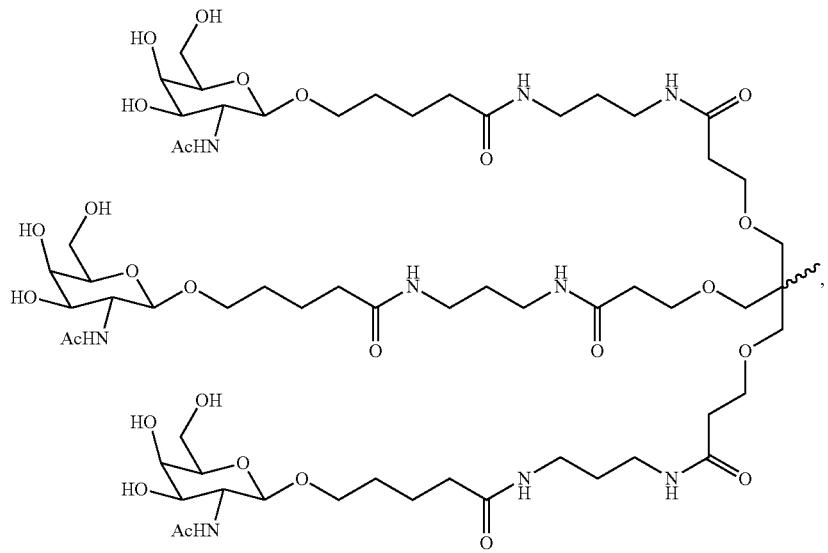

Formula II

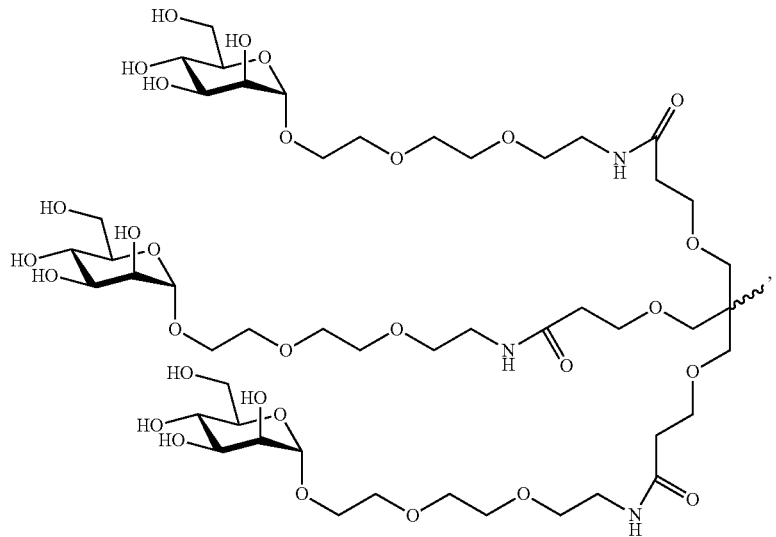

Formula III

-continued
Formula IV
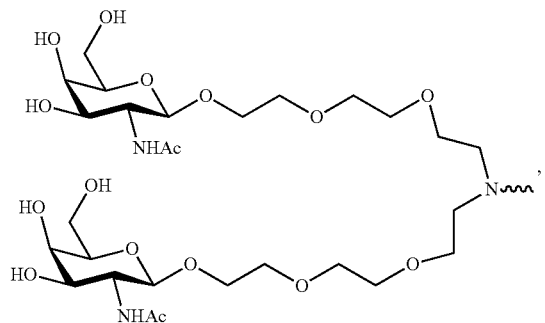
Formula V
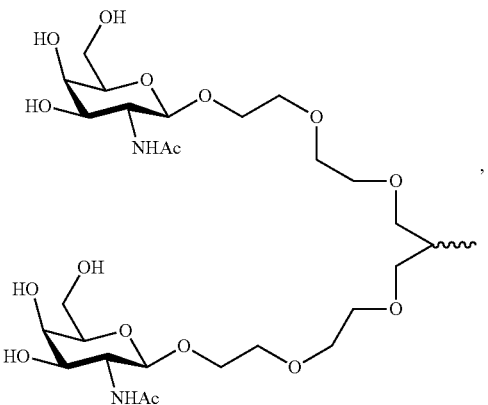
Formula VI
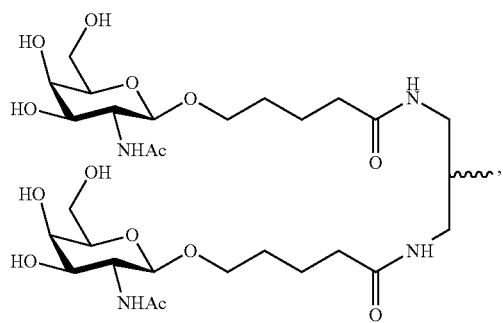
Formula VII
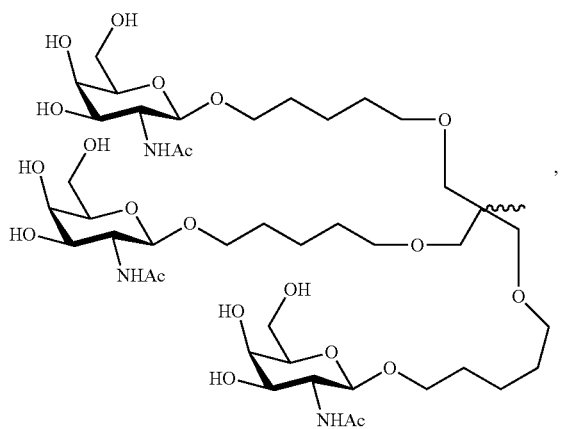
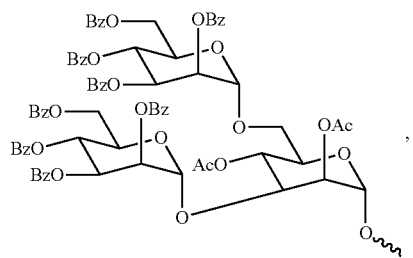
Formula VIII
Formula IX
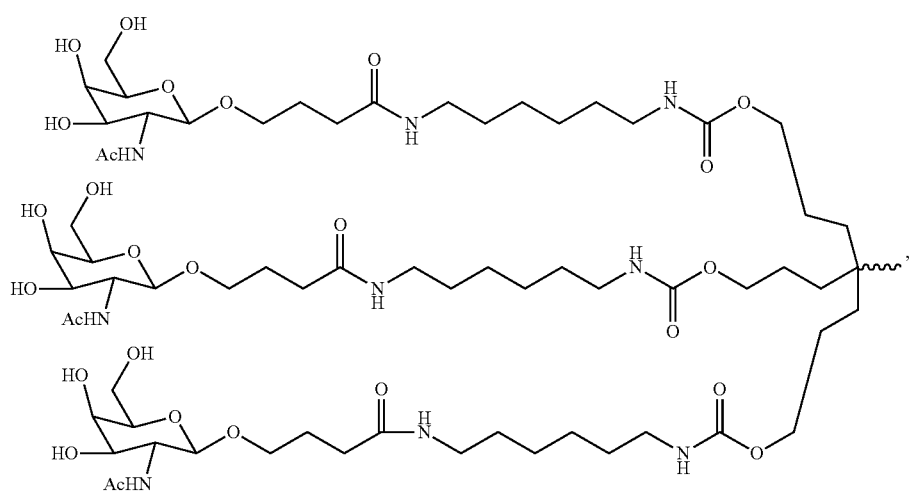

Formula X
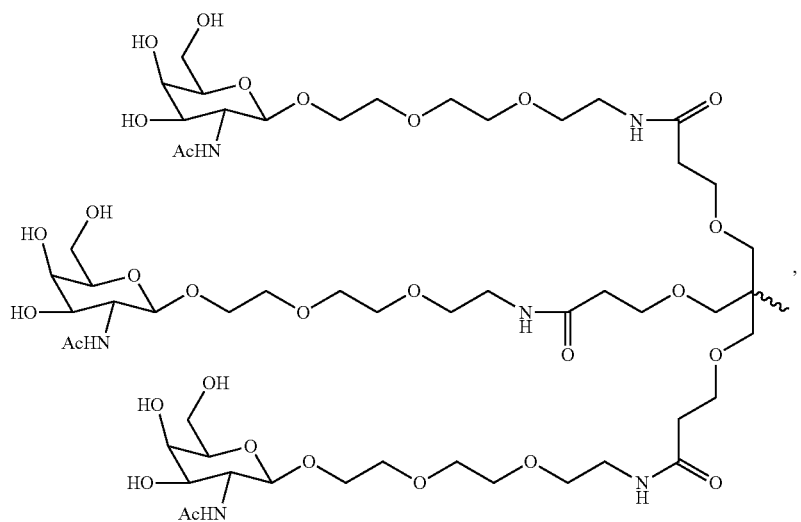
Formula XI
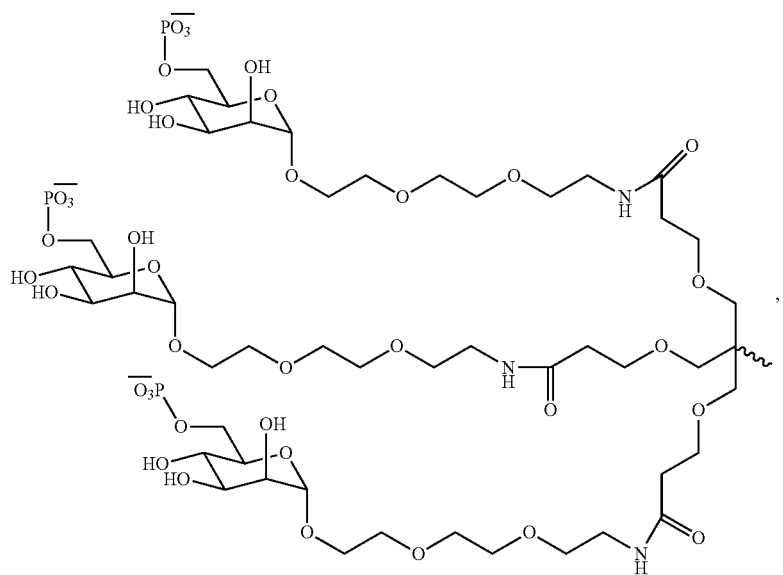

-continued
Formula XII
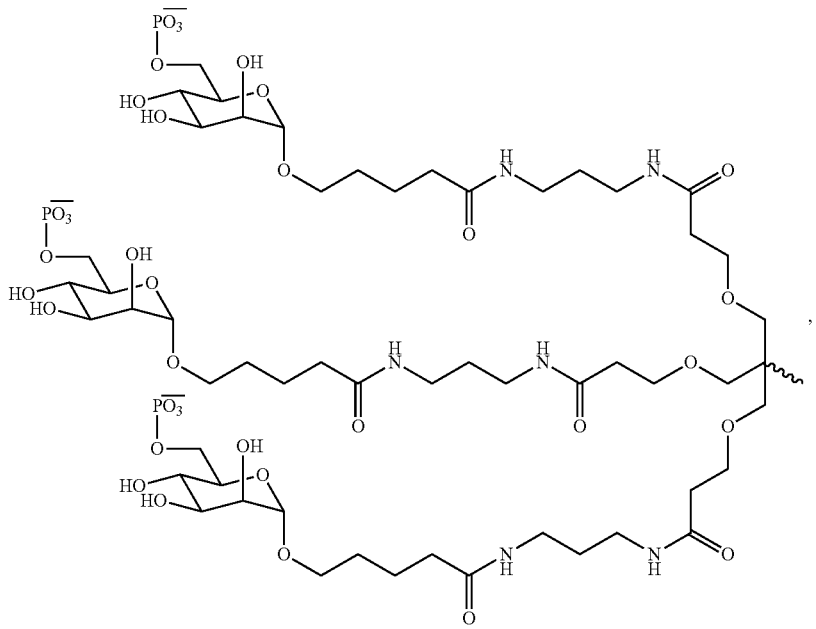
Formula XIII
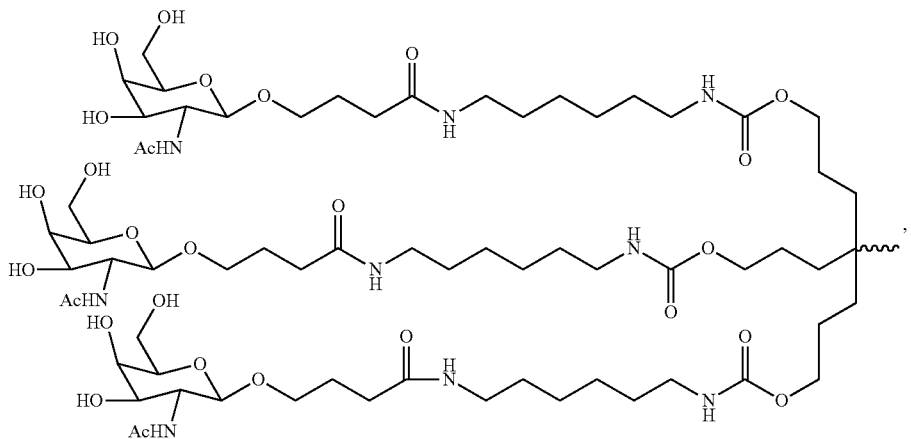
Formula XIV
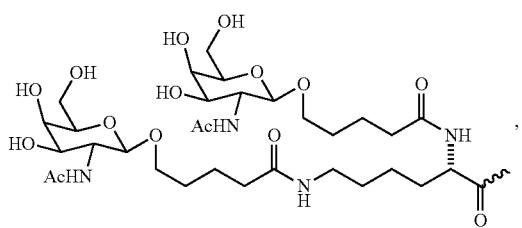
Formula XV
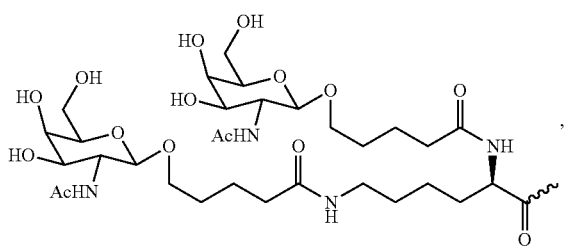
Formula XVI
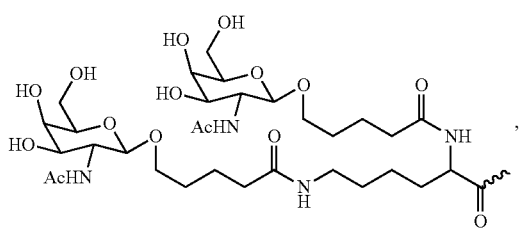
Formula XVII
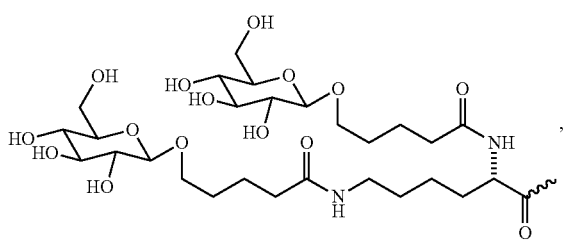

-continued
Formula XVIII
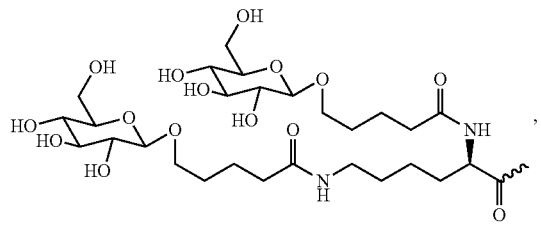,
Formula XIX
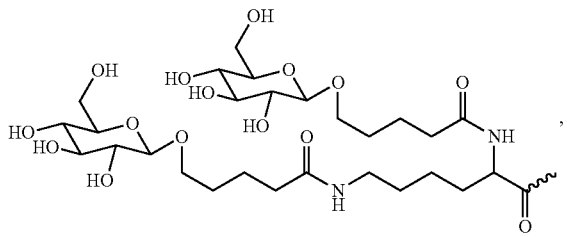,
Formula XX
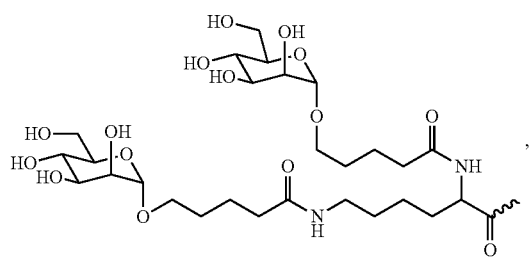,
Formula XXI
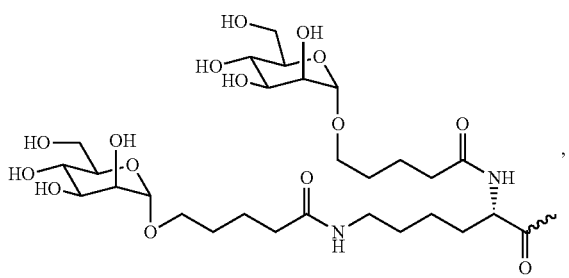,
Formula XXII
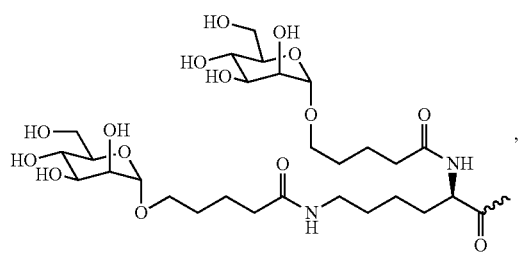,
Formula XXIII
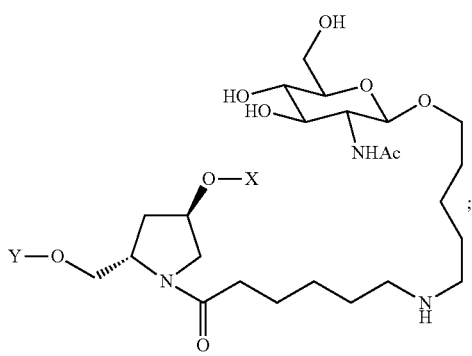;
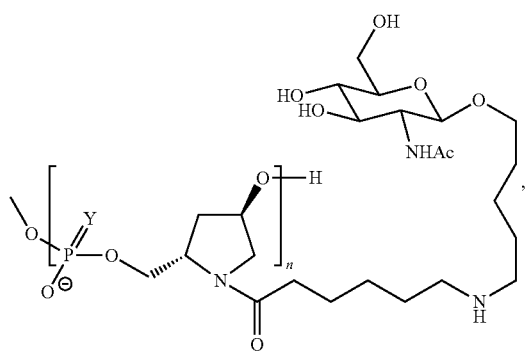, wherein Y is O or S and n is 3-6 (Formu
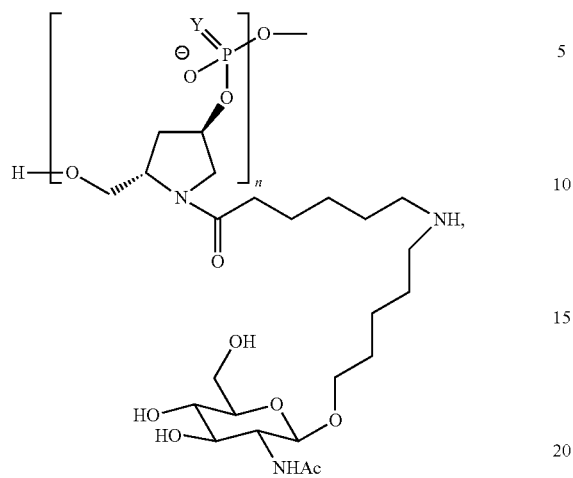
wherein Y is O or S and n is 3-6 (Formula XXV);
Formula XXVI
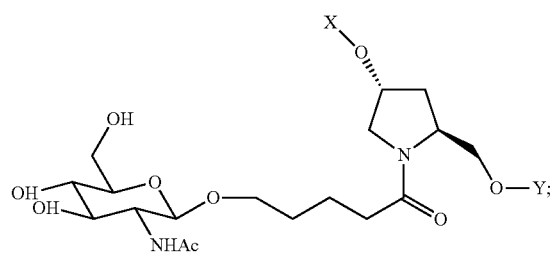
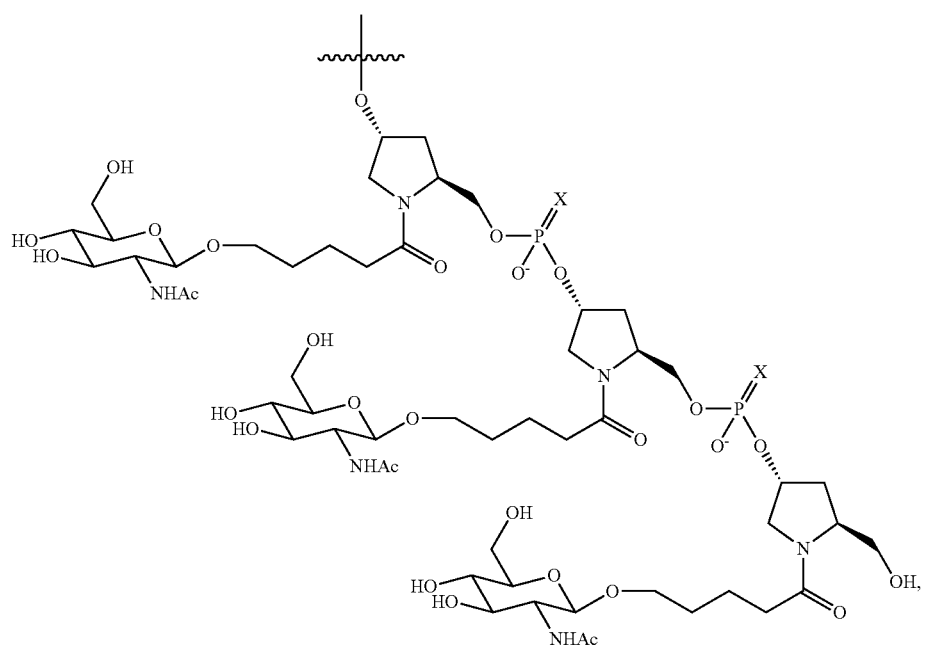

wherein X is O or S (Formula XXVII);
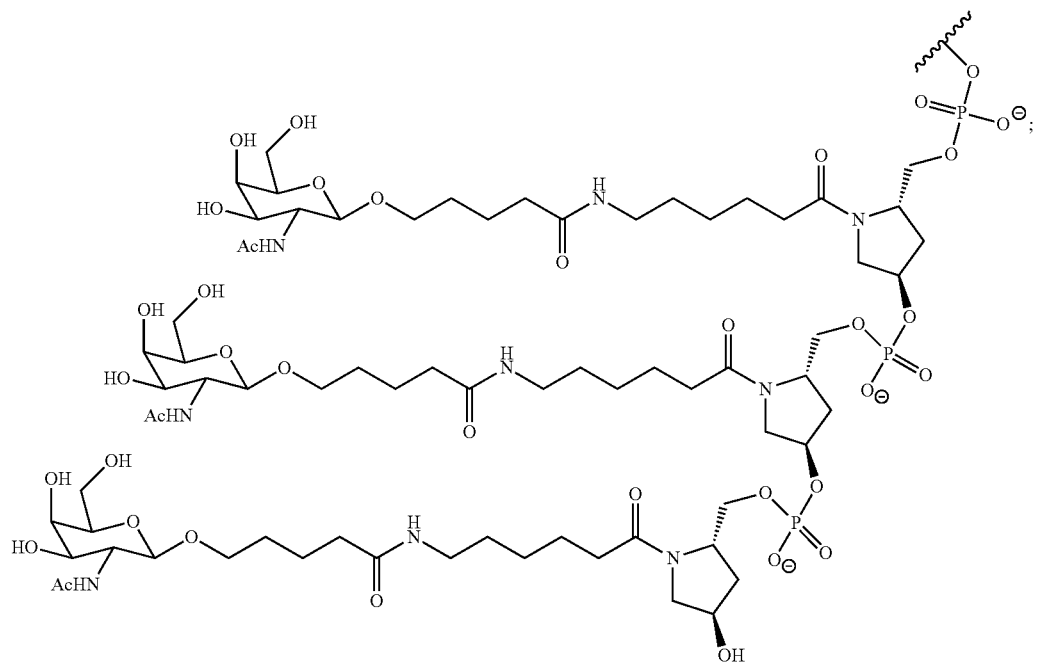
Formula XXVII
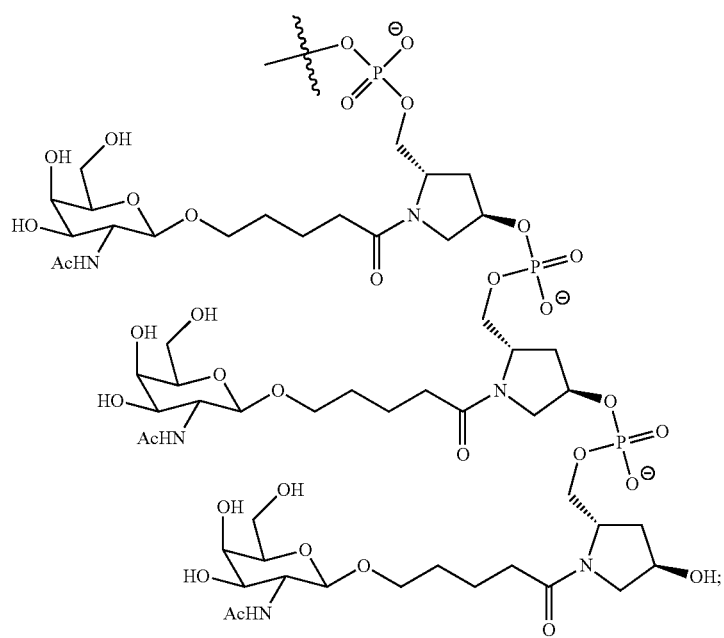
Formula XXIX Formula XXX
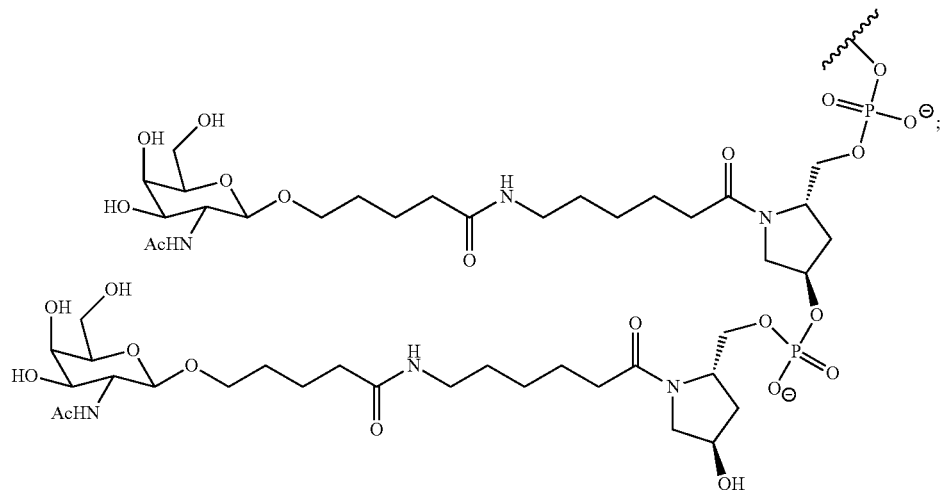
Formula XXXI
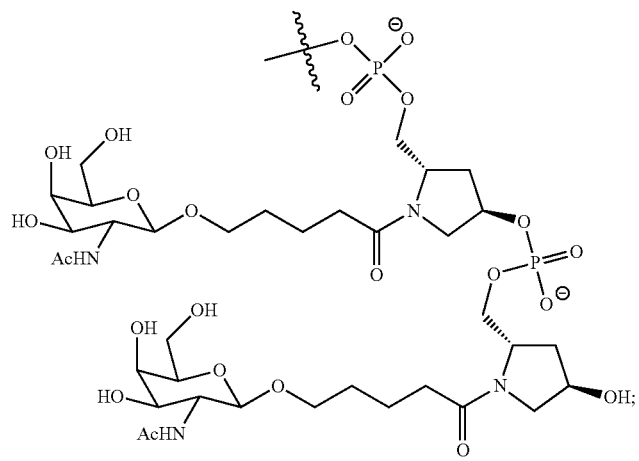
Formula XXXII
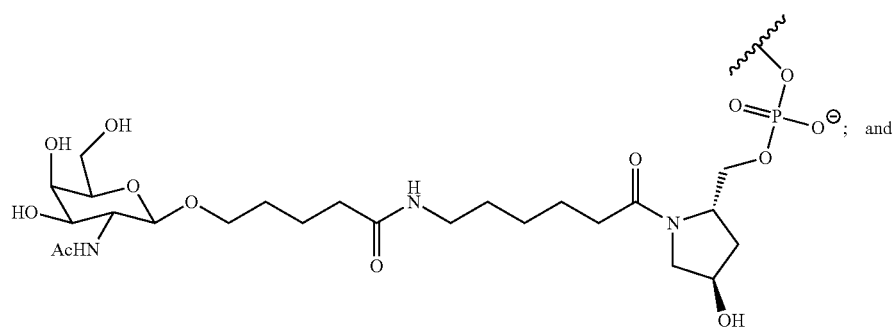
Formula XXXIII
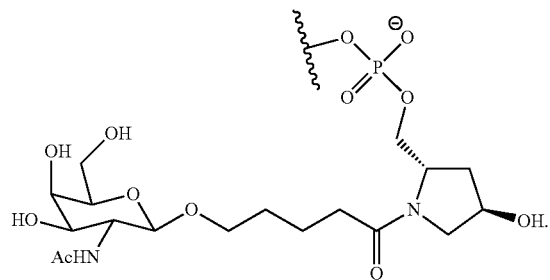

-continued

Formula XXXIV

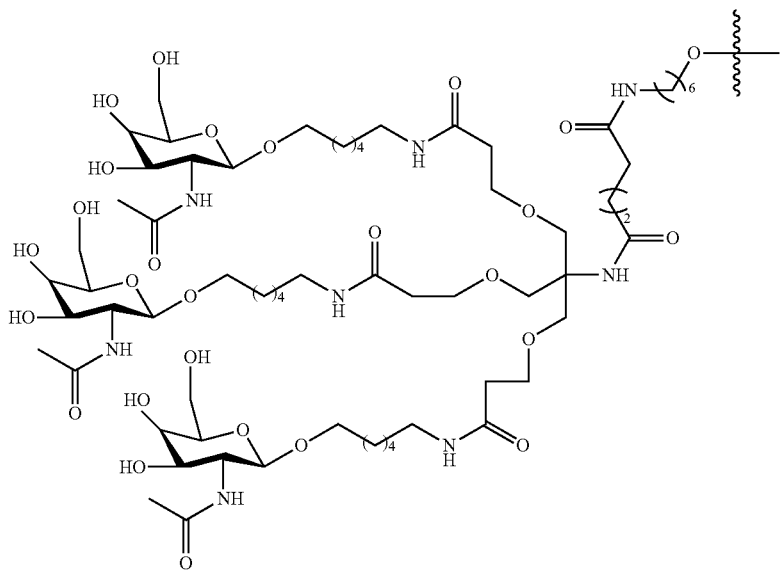

In another embodiment, a carbohydrate conjugate for use in the compositions and methods of the invention is a monosaccharide. In one embodiment, the monosaccharide is an N-acetylgalactosamine, such as Formula II

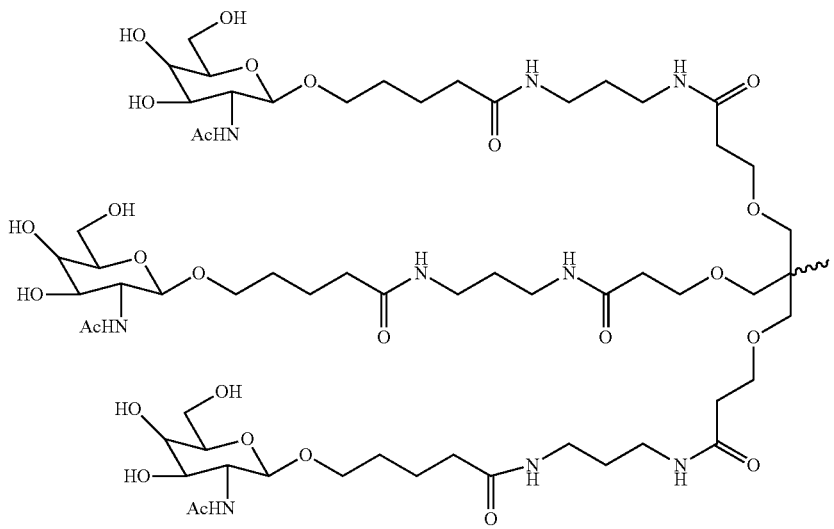

In some embodiments, the RNAi agent is attached to the carbohydrate conjugate via a linker as shown in the following schematic, wherein X is O or S

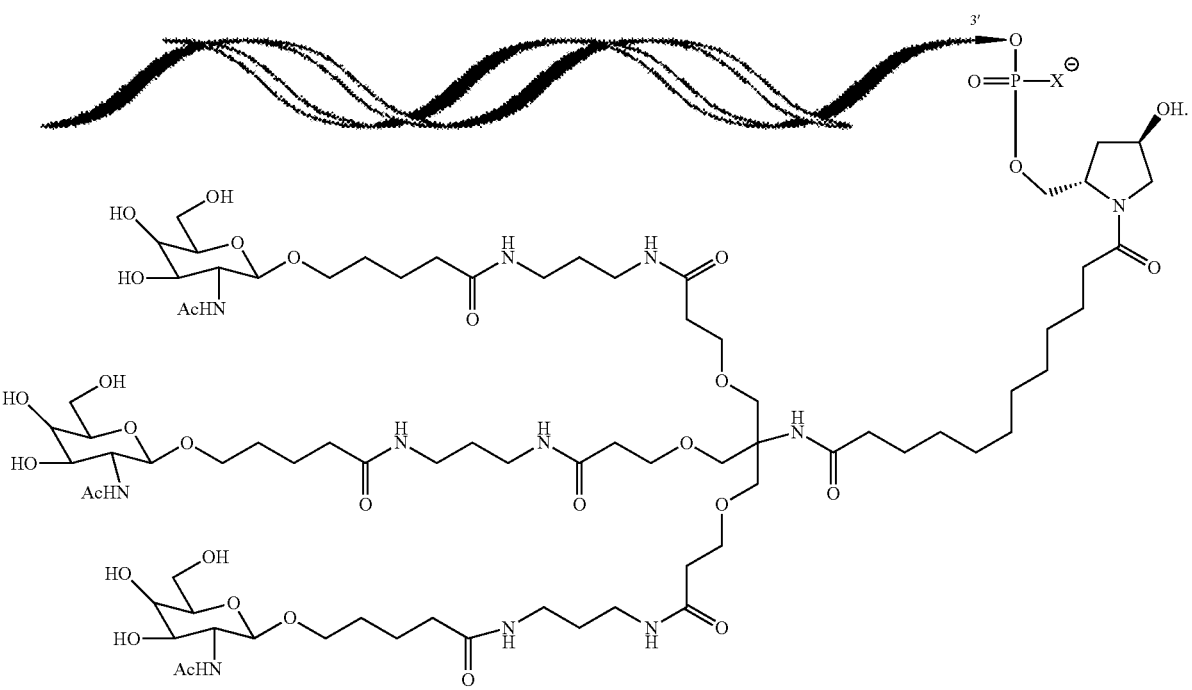
In some embodiments, the RNAi agent is conjugated to L96 as defined in Table 1 and shown below:
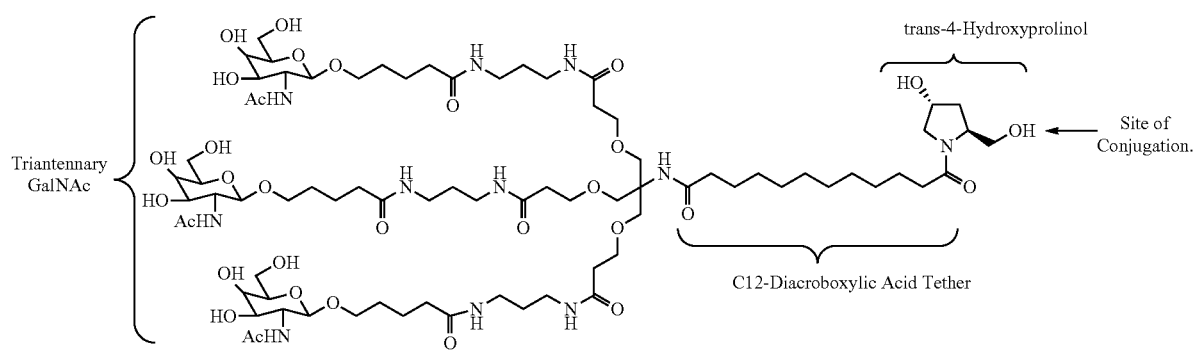
Another representative carbohydrate conjugate for use in the embodiments described herein includes, but is not limited to,

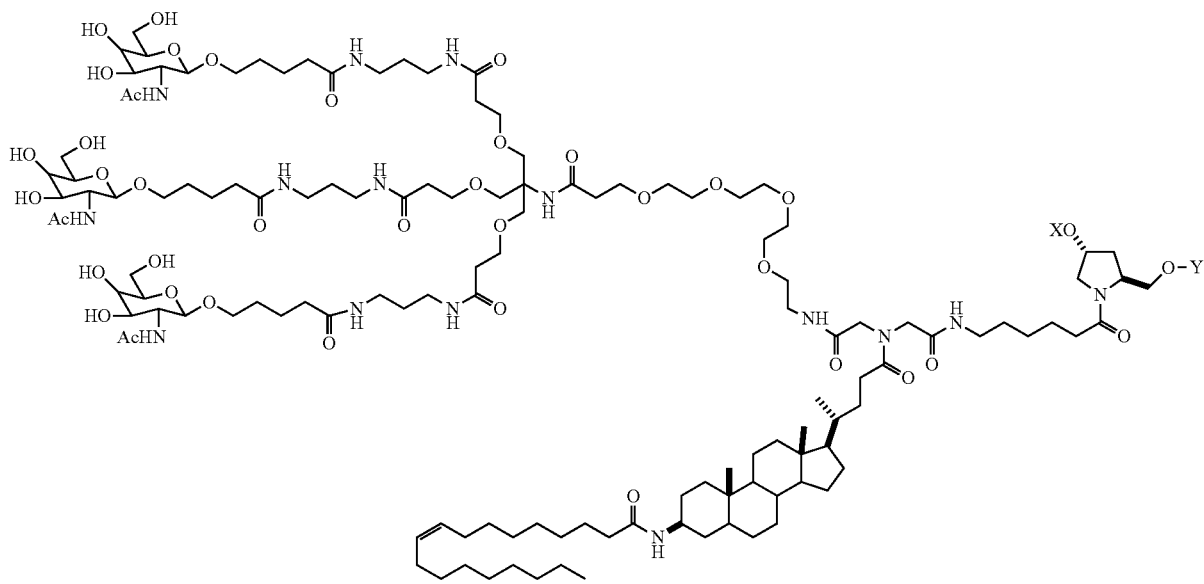

(Formula XXXVI), when one of X or Y is an oligonucleotide, the other is a hydrogen.

In some embodiments, a suitable ligand is a ligand disclosed in WO 2019/055633, the entire contents of which are incorporated herein by reference. In one embodiment the ligand comprises the structure below:

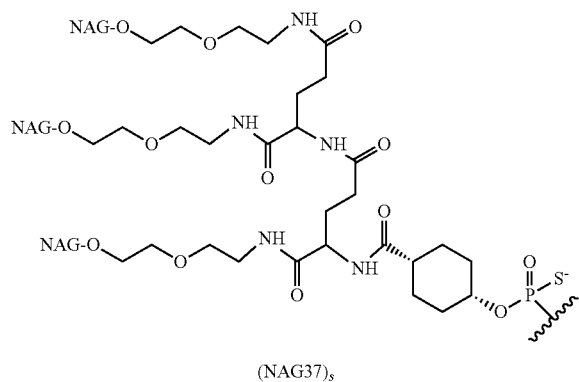

(NAG37)$_s$

In certain embodiments of the invention, the GalNAc or GalNAc derivative is attached to an iRNA agent of the invention via a monovalent linker. In some embodiments, the GalNAc or GalNAc derivative is attached to an iRNA agent of the invention via a bivalent linker. In yet other embodiments of the invention, the GalNAc or GalNAc derivative is attached to an iRNA agent of the invention via a trivalent linker.

In one embodiment, the double stranded RNAi agents of the invention comprise one or more GalNAc or GalNAc derivative attached to the iRNA agent. The GalNAc may be attached to any nucleotide via a linker on the sense strand or antisense strand. The GalNac may be attached to the 5'-end of the sense strand, the 3' end of the sense strand, the 5'-end of the antisense strand, or the 3'-end of the antisense strand. In one embodiment, the GalNAc is attached to the 3' end of the sense strand, e.g., via a trivalent linker.

In other embodiments, the double stranded RNAi agents of the invention comprise a plurality (e.g., 2, 3, 4, 5, or 6) GalNAc or GalNAc derivatives, each independently attached to a plurality of nucleotides of the double stranded RNAi agent through a plurality of linkers, e.g., monovalent linkers.

In some embodiments, for example, when the two strands of an iRNA agent of the invention is part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker.

In some embodiments, the carbohydrate conjugate further comprises one or more additional ligands as described above, such as, but not limited to, a PK modulator or a cell permeation peptide.

Additional carbohydrate conjugates and linkers suitable for use in the present invention include those described in PCT Publication Nos. WO 2014/179620 and WO 2014/179627, the entire contents of each of which are incorporated herein by reference.

D. Linkers

In some embodiments, the conjugate or ligand described herein can be attached to an iRNA oligonucleotide with various linkers that can be cleavable or non-cleavable.

The term "linker" or "linking group" means an organic moiety that connects two parts of a compound, e.g., covalently attaches two parts of a compound. Linkers typically comprise a direct bond or an atom such as oxygen or sulfur, a unit such as NR8, C(O), C(O)NH, SO, $SO_2$, $SO_2NH$ or a chain of atoms, such as, but not limited to, substituted or unsubstituted alkyl, substituted or unsubstituted alkenyl, substituted or unsubstituted alkynyl, arylalkyl, arylalkenyl, arylalkynyl, heteroarylalkyl, heteroarylalkenyl, heteroarylalkynyl, heterocyclylalkyl, heterocyclylalkenyl, heterocyclylalkynyl, aryl, heteroaryl, heterocyclyl, cycloalkyl, cycloalkenyl, alkylarylalkyl, alkylarylalkenyl, alkylarylalkynyl, alkenylarylalkyl, alkenylarylalkenyl, alkenylarylalkynyl, alkynylarylalkyl, alkynylarylalkenyl, alkynylarylalkynyl, alkylheteroarylalkyl, alkylheteroarylalkenyl, alkylheteroarylalkynyl, alkenylheteroarylalkyl, alkenylheteroarylalkenyl, alkenylheteroarylalkynyl, alkynylheteroarylalkyl, alkynylheteroarylalkenyl, alkynylheteroarylalkynyl, alkylheterocyclylalkyl, alkylheterocyclylalkenyl, alkylhererocyclylalkynyl, alkenylheterocyclylalkyl, alkenylheterocyclylalkenyl, alkenylheterocyclylalkynyl, alkynylheterocyclylalkyl, alkynylheterocyclylalkenyl, alkynylheterocyclylalkynyl, alkylaryl, alkenylaryl, alkynylaryl, alkylheteroaryl, alkenylheteroaryl, alkenylheteroaryl, which one or more methylenes can be interrupted or terminated by O, S, S(O), SO$_2$, N(R8), C(O), substituted or unsubstituted aryl, substituted or unsubstituted heteroaryl, or substituted or unsubstituted heterocyclic; where R8 is hydrogen, acyl, aliphatic, or substituted aliphatic. In one embodiment, the linker is about 1-24 atoms, 2-24, 3-24, 4-24, 5-24, 6-24, 6-18, 7-18, 8-18, 7-17, 8-17, 6-16, 7-17, or 8-16 atoms.

A cleavable linking group is one which is sufficiently stable outside the cell, but which upon entry into a target cell is cleaved to release the two parts the linker is holding together. In one embodiment, the cleavable linking group is cleaved at least about 10 times, 20, times, 30 times, 40 times, 50 times, 60 times, 70 times, 80 times, 90 times, or more, or at least 100 times faster in a target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH, redox potential, or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a selected pH, thereby releasing a cationic lipid from the ligand inside the cell, or into the desired compartment of the cell.

A linker can include a cleavable linking group that is cleavable by a particular enzyme. The type of cleavable linking group incorporated into a linker can depend on the cell to be targeted. For example, a liver-targeting ligand can be linked to a cationic lipid through a linker that includes an ester group. Liver cells are rich in esterases, and therefore the linker will be cleaved more efficiently in liver cells than in cell types that are not esterase-rich. Other cell-types rich in esterases include cells of the lung, renal cortex, and testis.

Linkers that contain peptide bonds can be used when targeting cell types rich in peptidases, such as liver cells and synoviocytes.

In general, the suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus, one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It can be useful to make initial evaluations in cell-free or culture conditions and to confirm by further evaluations in whole animals. In certain embodiments, useful candidate compounds are cleaved at least about 2, 4, 10, 20, 30, 40, 50, 60, 70, 80, 90, or 100 times faster in the cell (or under in vitro conditions selected to mimic intracellular conditions) as compared to blood or serum (or under in vitro conditions selected to mimic extracellular conditions).

i. Redox Cleavable Linking Groups

In certain embodiments, a cleavable linking group is a redox cleavable linking group that is cleaved upon reduction or oxidation. An example of reductively cleavable linking group is a disulphide linking group (—S—S—). To determine if a candidate cleavable linking group is a suitable "reductively cleavable linking group," or for example is suitable for use with a particular iRNA moiety and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In one, candidate compounds are cleaved by at most about 10% in the blood. In other embodiments, useful candidate compounds are degraded at least about 2, 4, 10, 20, 30, 40, 50, 60, 70, 80, 90, or about 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

ii. Phosphate-Based Cleavable Linking Groups

In other embodiments, a cleavable linker comprises a phosphate-based cleavable linking group. A phosphate-based cleavable linking group is cleaved by agents that degrade or hydrolyze the phosphate group. An example of an agent that cleaves phosphate groups in cells are enzymes such as phosphatases in cells. Examples of phosphate-based linking groups are —O—P(O)(ORk)-O—, —O—P(S)(ORk)-O—, —O—P(S)(SRk)-O—, —S—P(O)(ORk)-O—, —O—P(O)(ORk)-S—, —S—P(O)(ORk)-S—, —O—P(S)(ORk)-S—, —S—P(S)(ORk)-O—, —O—P(O)(Rk)-O—, —O—P(S)(Rk)-O—, —S—P(O)(Rk)-O—, —S—P(S)(Rk)-O—, —S—P(O)(Rk)-S—, —O—P(S)(Rk)-S—, wherein Rk at each occurrence can be, independently, C1-C20 alkyl, C1-C20 haloalkyl, C6-C10 aryl, or C7-C12 aralkyl. Exemplary embodiments include —O—P(O)(OH)—O—, —O—P(S)(OH)—O—, —O—P(S)(SH)—O—, —S—P(O)(OH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O, —S—P(S)(H)—O—, —S—P(O)(H)—S—, and —O—P(S)(H)—S—. In certain embodiments, a phosphate-based linking group is —O—P(O)(OH)—O—. These candidates can be evaluated using methods analogous to those described above.

iii. Acid Cleavable Linking Groups

In other embodiments, a cleavable linker comprises an acid cleavable linking group. An acid cleavable linking group is a linking group that is cleaved under acidic conditions. In certain embodiments acid cleavable linking groups are cleaved in an acidic environment with a pH of about 6.5 or lower (e.g., about 6.0, 5.5, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C=NN—, C(O)O, or —OC(O). An exemplary embodiment is when the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

iv. Ester-Based Linking Groups

In other embodiments, a cleavable linker comprises an ester-based cleavable linking group. An ester-based cleavable linking group is cleaved by enzymes such as esterases and amidases in cells. Examples of ester-based cleavable linking groups include, but are not limited to, esters of alkylene, alkenylene and alkynylene groups. Ester cleavable linking groups have the general formula —C(O)O—, or —OC(O)—. These candidates can be evaluated using methods analogous to those described above.

v. Peptide-Based Cleaving Groups

In yet other embodiments, a cleavable linker comprises a peptide-based cleavable linking group. A peptide-based cleavable linking group is cleaved by enzymes such as peptidases and proteases in cells. Peptide-based cleavable linking groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene or alkynelene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleavable linking groups have the general formula —NHCHRAC(O) NHCHRBC(O)—, where RA and RB are the R groups of the two adjacent amino acids. These candidates can be evaluated using methods analogous to those described above.

In some embodiments, an iRNA of the invention is conjugated to a carbohydrate through a linker. Non-limiting examples of iRNA carbohydrate conjugates with linkers of the compositions and methods of the invention include, but are not limited to,

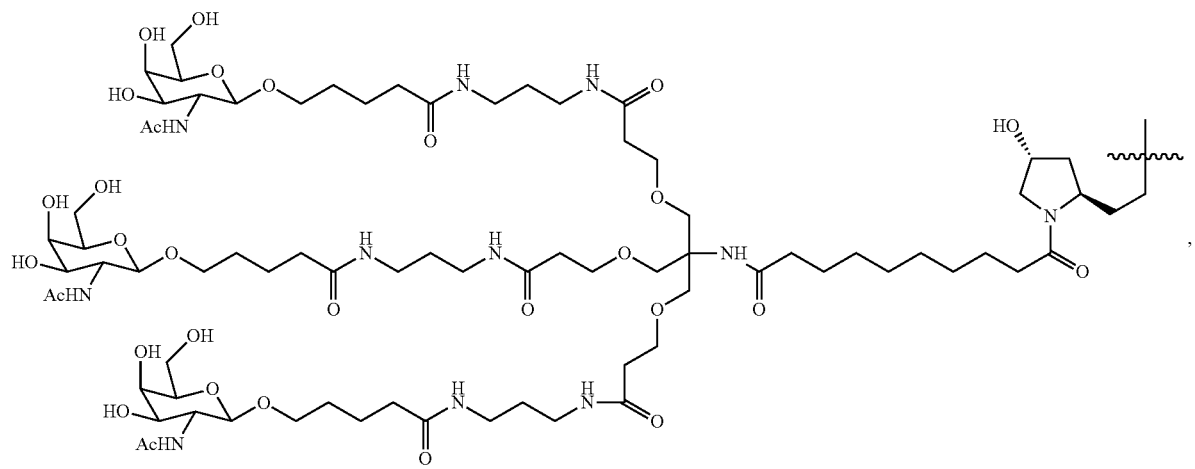

(Formula XXXVII)

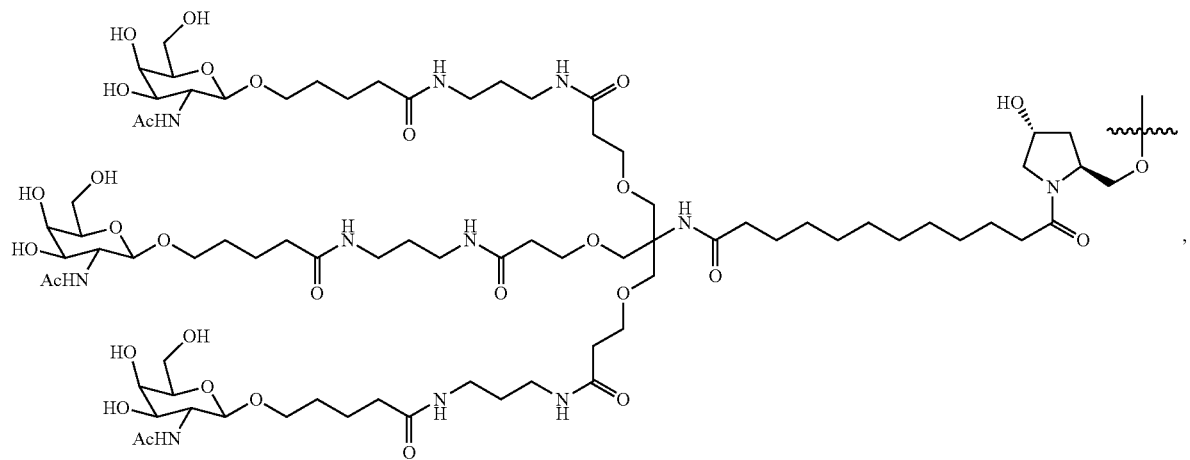

(Formula XXXVIII)

-continued
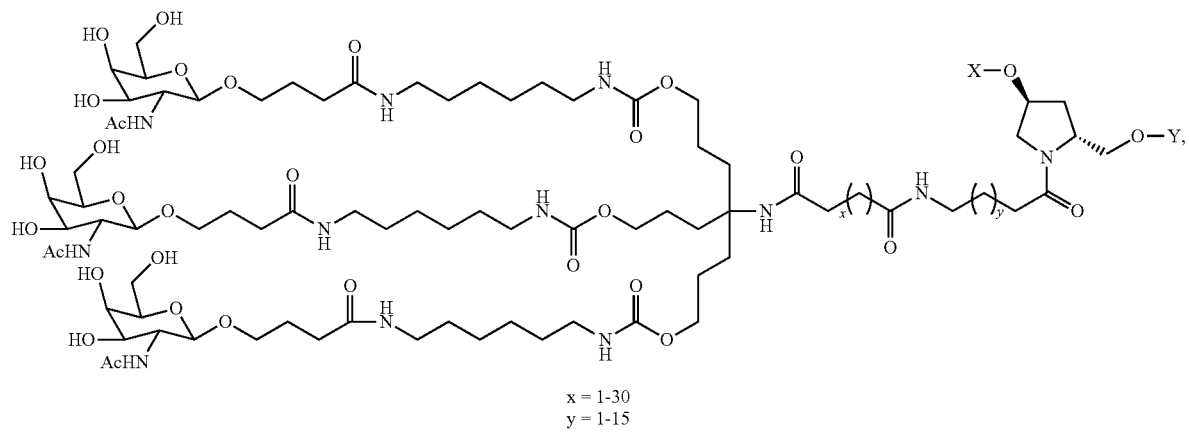
(Formula XXXIX)
x = 1-30
y = 1-15
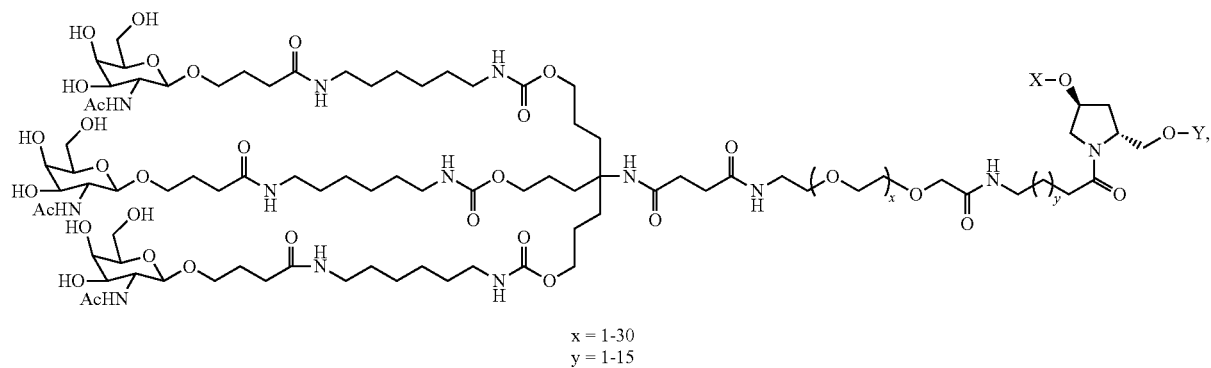
(Formula XL)
x = 1-30
y = 1-15
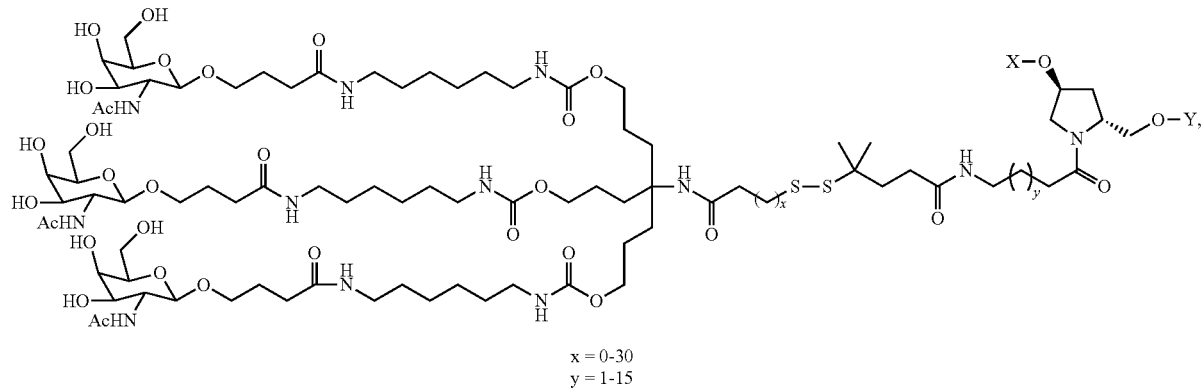
(Formula XLI)
x = 0-30
y = 1-15

(Formula XLII)

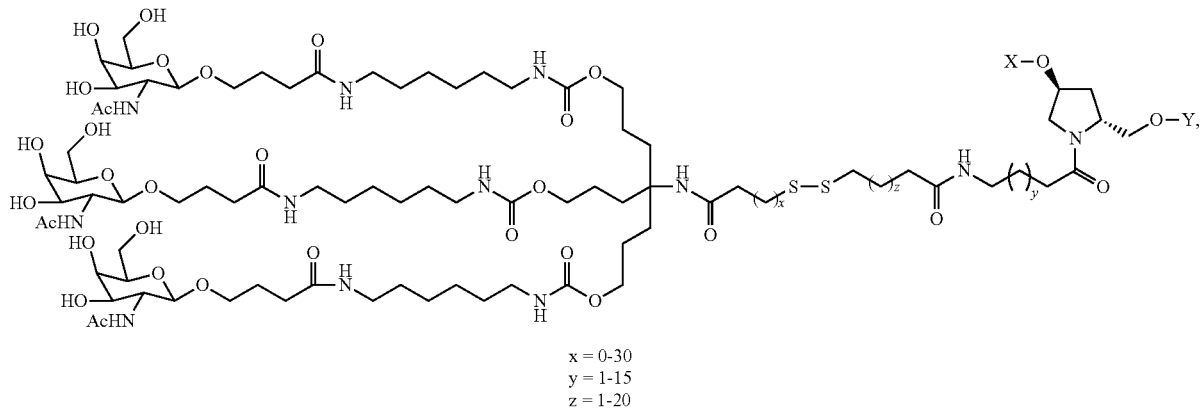

x = 0-30
y = 1-15
z = 1-20

(Formula XLIII)

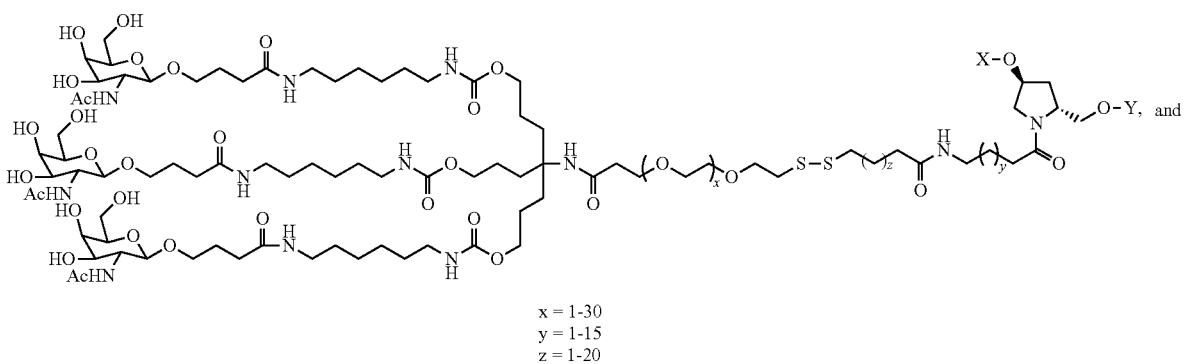

x = 1-30
y = 1-15
z = 1-20

(Formula XLIV)

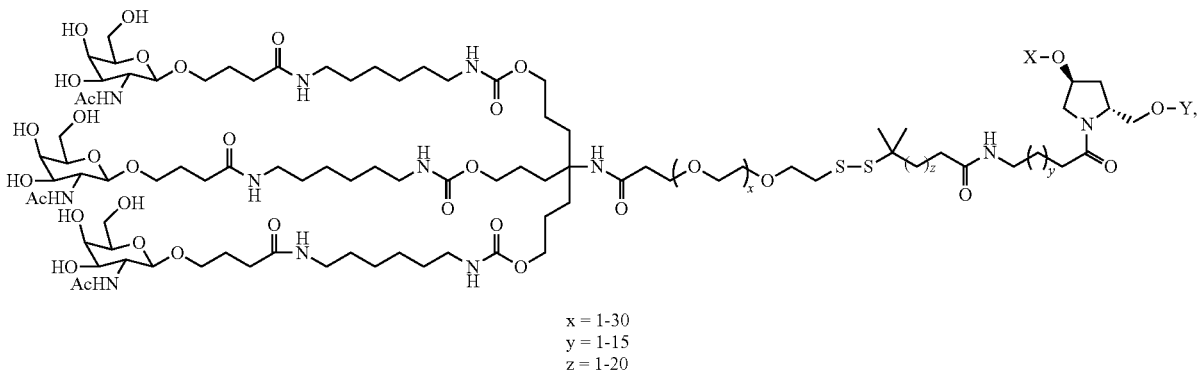

x = 1-30
y = 1-15
z = 1-20 when one of X or Y is an oligonucleotide, the other is a hydrogen.

In certain embodiments of the compositions and methods of the invention, a ligand is one or more "GalNAc" (N-acetylgalactosamine) derivatives attached through a bivalent or trivalent branched linker.

In one embodiment, a dsRNA of the invention is conjugated to a bivalent or trivalent branched linker selected from the group of structures shown in any of formula (XLV)-(XLVIII):

Formula XLV

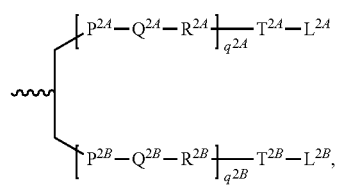

Formula XLVI

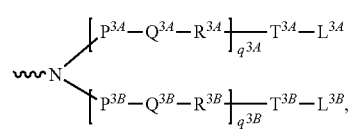

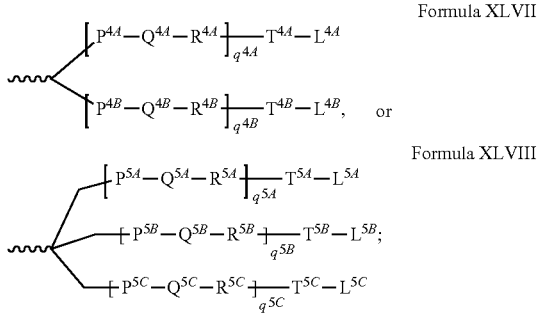

Formula XLVII

Formula XLVIII wherein:
q2A, q2B, q3A, q3B, q4A, q4B, q5A, q5B and q5C represent independently for each occurrence 0-20 and wherein the repeating unit can be the same or different;
$P^{2A}$, $P^{2B}$, $P^{3A}$, $P^{3B}$, $P^{4A}$, $P^{4B}$, $P^{5A}$, $P^{5B}$, $P^{5C}$, $T^{2A}$, $T^{2B}$, $T^{3A}$, $T^{3B}$, $T^{4A}$, $T^{4B}$, $T^{4A}$, $T^{5B}$, $T^{5C}$ are each independently for each occurrence absent, CO, NH, O, S, OC(O), NHC(O), $CH_2$, $CH_2NH$ or $CH_2O$;
$Q^{2A}$, $Q^{2B}$, $Q^{3A}$, $Q^{3B}$, $Q^{4A}$, $Q^{4B}$, $Q^{5A}$, $Q^{5B}$, $Q^{5C}$ are independently for each occurrence absent, alkylene, substituted alkylene wherein one or more methylenes can be interrupted or terminated by one or more of O, S, S(O), $SO_2$, $N(R^N)$, $C(R')=C(R'')$, $C\equiv C$ or C(O);
$R^{2A}$, $R^{2B}$, $R^{3A}$, $R^{3B}$, $R^{4A}$, $R^{4B}$, $R^{5A}$, $R^{5B}$, $R^{5C}$ are each independently for each occurrence absent, NH, O, S, $CH_2$, C(O)O, C(O)NH, $NHCH(R^a)C(O)$, —C(O)—CH$(R^a)$—NH—, CO, CH=N—O,

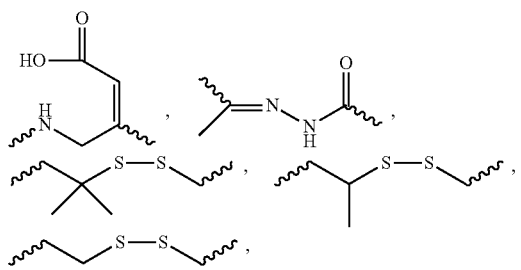

or heterocyclyl;
$L^{2A}$, $L^{2B}$, $L^{3A}$, $L^{3B}$, $L^{4A}$, $L^{4B}$, $L^{5A}$, $L^{5B}$ and $L^{5C}$ represent the ligand; i.e. each independently for each occurrence a monosaccharide (such as GalNAc), disaccharide, trisaccharide, tetrasaccharide, oligosaccharide, or polysaccharide; and $R^a$ is H or amino acid side chain. Trivalent conjugating GalNAc derivatives are particularly useful for use with RNAi agents for inhibiting the expression of a target gene, such as those of formula (XLIX):

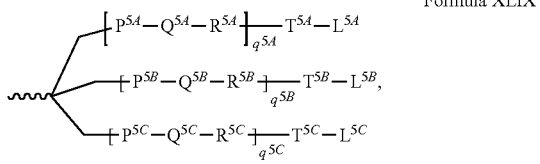

Formula XLIX wherein $L^{5A}$, $L^{5B}$ and $L^{5C}$ represent a monosaccharide, such as GalNAc derivative.

Examples of suitable bivalent and trivalent branched linker groups conjugating GalNAc derivatives include, but are not limited to, the structures recited above as formulas II, VII, XI, X, and XIII.

Representative U.S. patents that teach the preparation of RNA conjugates include, but are not limited to, U.S. Pat. Nos. 4,828,979; 4,948,882; 5,218,105; 5,525,465; 5,541,313; 5,545,730; 5,552,538; 5,578,717; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928; 5,688,941; 6,294,664; 6,320,017; 6,576,752; 6,783,931; 6,900,297; 7,037,646; and 8,106,022, the entire contents of each of which are hereby incorporated herein by reference.

It is not necessary for all positions in a given compound to be uniformly modified, and in fact more than one of the aforementioned modifications can be incorporated in a single compound or even at a single nucleoside within an iRNA. The present invention also includes iRNA compounds that are chimeric compounds.

"Chimeric" iRNA compounds or "chimeras," in the context of this invention, are iRNA compounds, such as, dsRNAi agents, that contain two or more chemically distinct regions, each made up of at least one monomer unit, i.e., a nucleotide in the case of a dsRNA compound. These iRNAs typically contain at least one region wherein the RNA is modified so as to confer upon the iRNA increased resistance to nuclease degradation, increased cellular uptake, or increased binding affinity for the target nucleic acid. An additional region of the iRNA can serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of iRNA inhibition of gene expression. Consequently, comparable results can often be obtained with shorter iRNAs when chimeric dsRNAs are used, compared to phosphorothioate deoxy dsRNAs hybridizing to the same target region. Cleavage of the RNA target can be routinely detected by gel electrophoresis and, if necessary, associated nucleic acid hybridization techniques known in the art.

In certain instances, the RNA of an iRNA can be modified by a non-ligand group. A number of non-ligand molecules have been conjugated to iRNAs in order to enhance the activity, cellular distribution or cellular uptake of the iRNA, and procedures for performing such conjugations are available in the scientific literature. Such non-ligand moieties have included lipid moieties, such as cholesterol (Kubo, T. et al., *Biochem. Biophys. Res. Comm.*, 2007, 365(1):54-61; Letsinger et al., *Proc. Natl. Acad. Sci. USA*, 1989, 86:6553), cholic acid (Manoharan et al., *Bioorg. Med. Chem. Lett.*, 1994, 4:1053), a thioether, e.g., hexyl-S-tritylthiol (Manoharan et al., *Ann. N.Y. Acad. Sci.*, 1992, 660:306; Manoharan et al., *Bioorg. Med. Chem. Let.*, 1993, 3:2765), a thiocholesterol (Oberhauser et al., *Nucl. Acids Res.*, 1992, 20:533), an aliphatic chain, e.g., dodecandiol or undecyl residues (Saison-Behmoaras et al., *EMBO J.*, 1991, 10:111; Kabanov et al., *FEBS Lett.*, 1990, 259:327; Svinarchuk et al., *Biochimie*, 1993, 75:49), a phospholipid, e.g., di-hexadecylrac-glycerol or triethylammonium 1,2-di-O-hexadecyl-rac-glycero-3-H-phosphonate (Manoharan et al., *Tetrahedron Lett.,* 1995, 36:3651; Shea et al., *Nucl. Acids Res.,* 1990, 18:3777), a polyamine or a polyethylene glycol chain (Manoharan et al., *Nucleosides & Nucleotides,* 1995, 14:969), or adamantane acetic acid (Manoharan et al., *Tetrahedron Lett.,* 1995, 36:3651), a palmityl moiety (Mishra et al., *Biochim. Biophys. Acta,* 1995, 1264:229), or an octadecylamine or hexylamino-carbonyl-oxycholesterol moiety (Crooke et al., *J. Pharmacol. Exp. Ther.,* 1996, 277:923). Representative United States patents that teach the preparation of such RNA conjugates have been listed above. Typical conjugation protocols involve the synthesis of RNAs bearing an aminolinker at one or more positions of the sequence. The amino group is then reacted with the molecule being conjugated using appropriate coupling or activating reagents. The conjugation reaction can be performed either with the RNA still bound to the solid support or following cleavage of the RNA, in solution phase. Purification of the RNA conjugate by HPLC typically affords the pure conjugate.

IV. Delivery of an iRNA of the Invention

The delivery of an iRNA of the invention to a cell e.g., a cell within a subject, such as a human subject (e.g., a subject in need thereof, such as a subject susceptible to or diagnosed with a complement factor B-associated disorder) can be achieved in a number of different ways. For example, delivery may be performed by contacting a cell with an iRNA of the invention either in vitro or in vivo. In vivo delivery may also be performed directly by administering a composition comprising an iRNA, e.g., a dsRNA, to a subject. Alternatively, in vivo delivery may be performed indirectly by administering one or more vectors that encode and direct the expression of the iRNA. These alternatives are discussed further below.

In general, any method of delivering a nucleic acid molecule (in vitro or in vivo) can be adapted for use with an iRNA of the invention (see e.g., Akhtar S. and Julian R L. (1992) *Trends Cell. Biol.* 2(5):139-144 and WO94/02595, which are incorporated herein by reference in their entireties). For in vivo delivery, factors to consider in order to deliver an iRNA molecule include, for example, biological stability of the delivered molecule, prevention of non-specific effects, and accumulation of the delivered molecule in the target tissue. RNA interference has also shown success with local delivery to the CNS by direct injection (Dorn, G., et al. (2004) *Nucleic Acids* 32:e49; Tan, P H., et al (2005) *Gene Ther.* 12:59-66; Makimura, H., et al (2002) *BMC Neurosci.* 3:18; Shishkina, G T., et al (2004) *Neuroscience* 129:521-528; Thakker, E R., et al (2004) *Proc. Natl. Acad. Sci. U.S.A.* 101:17270-17275; Akaneya, Y., et al (2005) *J. Neurophysiol.* 93:594-602). Modification of the RNA or the pharmaceutical carrier can also permit targeting of the iRNA to the target tissue and avoid undesirable off-target effects. iRNA molecules can be modified by chemical conjugation to lipophilic groups such as cholesterol to enhance cellular uptake and prevent degradation. For example, an iRNA directed against ApoB conjugated to a lipophilic cholesterol moiety was injected systemically into mice and resulted in knockdown of apoB mRNA in both the liver and jejunum (Soutschek, J., et al (2004) *Nature* 432:173-178).

In an alternative embodiment, the iRNA can be delivered using drug delivery systems such as a nanoparticle, a dendrimer, a polymer, liposomes, or a cationic delivery system. Positively charged cationic delivery systems facilitate binding of an iRNA molecule (negatively charged) and also enhance interactions at the negatively charged cell membrane to permit efficient uptake of an iRNA by the cell. Cationic lipids, dendrimers, or polymers can either be bound to an iRNA, or induced to form a vesicle or micelle (see e.g., Kim S H, et al (2008) *Journal of Controlled Release* 129(2):107-116) that encases an iRNA. The formation of vesicles or micelles further prevents degradation of the iRNA when administered systemically. Methods for making and administering cationic—iRNA complexes are well within the abilities of one skilled in the art (see e.g., Sorensen, D R, et al (2003) *J. Mol. Biol* 327:761-766; Verma, U N, et al (2003) Clin. *Cancer Res.* 9:1291-1300; Arnold, A S et al (2007) *J. Hypertens.* 25:197-205, which are incorporated herein by reference in their entirety). Some non-limiting examples of drug delivery systems useful for systemic delivery of iRNAs include DOTAP (Sorensen, D R., et al (2003), supra; Verma, U N, et al (2003), supra), "solid nucleic acid lipid particles" (Zimmermann, T S, et al (2006) *Nature* 441:111-114), cardiolipin (Chien, P Y, et al (2005) *Cancer Gene Ther.* 12:321-328; Pal, A, et al (2005) *Int J. Oncol.* 26:1087-1091), polyethyleneimine (Bonnet M E, et al (2008) *Pharm. Res.* August 16 Epub ahead of print; Aigner, A. (2006) *J. Biomed. Biotechnol.* 71659), Arg-Gly-Asp (RGD) peptides (Liu, S. (2006) *Mol. Pharm.* 3:472-487), and polyamidoamines (Tomalia, D A, et al (2007) *Biochem. Soc. Trans.* 35:61-67; Yoo, H., et al (1999) *Pharm. Res.* 16:1799-1804). In some embodiments, an iRNA forms a complex with cyclodextrin for systemic administration. Methods for administration and pharmaceutical compositions of iRNAs and cyclodextrins can be found in U.S. Pat. No. 7,427,605, which is herein incorporated by reference in its entirety.

A. Vector Encoded iRNAs of the Invention iRNA targeting the complement factor B gene can be expressed from transcription units inserted into DNA or RNA vectors (see, e.g., Couture, A, et al., *TIG.* (1996), 12:5-10; Skillern, A, et al., International PCT Publication No. WO 00/22113, Conrad, International PCT Publication No. WO 00/22114, and Conrad, U.S. Pat. No. 6,054,299). Expression can be transient (on the order of hours to weeks) or sustained (weeks to months or longer), depending upon the specific construct used and the target tissue or cell type. These transgenes can be introduced as a linear construct, a circular plasmid, or a viral vector, which can be an integrating or non-integrating vector. The transgene can also be constructed to permit it to be inherited as an extrachromosomal plasmid (Gassmann, et al., *Proc. Natl. Acad. Sci. USA* (1995) 92:1292).

Viral vector systems which can be utilized with the methods and compositions described herein include, but are not limited to, (a) adenovirus vectors; (b) retrovirus vectors, including but not limited to lentiviral vectors, moloney murine leukemia virus, etc.; (c) adeno-associated virus vectors; (d) herpes simplex virus vectors; (e) SV 40 vectors; (f) polyoma virus vectors; (g) papilloma virus vectors; (h) picornavirus vectors; (i) pox virus vectors such as an orthopox, e.g., vaccinia virus vectors or avipox, e.g. canary pox or fowl pox; and (j) a helper-dependent or gutless adenovirus. Replication-defective viruses can also be advantageous. Different vectors will or will not become incorporated into the cells' genome. The constructs can include viral sequences for transfection, if desired. Alternatively, the construct can be incorporated into vectors capable of episomal replication, e.g. EPV and EBV vectors. Constructs for the recombinant expression of an iRNA will generally require regulatory elements, e.g., promoters, enhancers, etc., to ensure the expression of the iRNA in target cells. Other aspects to consider for vectors and constructs are known in the art.

V. Pharmaceutical Compositions of the Invention

The present invention also includes pharmaceutical compositions and formulations which include the iRNAs of the invention. In one embodiment, provided herein are pharmaceutical compositions containing an iRNA, as described herein, and a pharmaceutically acceptable carrier. The pharmaceutical compositions containing the iRNA are useful for preventing or treating a complement factor B-associated disorder. Such pharmaceutical compositions are formulated based on the mode of delivery. One example is compositions that are formulated for systemic administration via parenteral delivery, e.g., by subcutaneous (SC), intramuscular (IM), or intravenous (IV) delivery. The pharmaceutical compositions of the invention may be administered in dosages sufficient to inhibit expression of a complement factor B gene.

In some embodiments, the pharmaceutical compositions of the invention are sterile. In another embodiment, the pharmaceutical compositions of the invention are pyrogen free.

The pharmaceutical compositions of the invention may be administered in dosages sufficient to inhibit expression of a complement factor B gene. In general, a suitable dose of an iRNA of the invention will be in the range of about 0.001 to about 200.0 milligrams per kilogram body weight of the recipient per day, generally in the range of about 1 to 50 mg per kilogram body weight per day. Typically, a suitable dose of an iRNA of the invention will be in the range of about 0.1 mg/kg to about 5.0 mg/kg, such as, about 0.3 mg/kg and about 3.0 mg/kg. A repeat-dose regimen may include administration of a therapeutic amount of iRNA on a regular basis, such as every month, once every 3-6 months, or once a year. In certain embodiments, the iRNA is administered about once per month to about once per six months.

After an initial treatment regimen, the treatments can be administered on a less frequent basis. Duration of treatment can be determined based on the severity of disease.

In other embodiments, a single dose of the pharmaceutical compositions can be long lasting, such that doses are administered at not more than 1, 2, 3, or 4 month intervals. In some embodiments of the invention, a single dose of the pharmaceutical compositions of the invention is administered about once per month. In other embodiments of the invention, a single dose of the pharmaceutical compositions of the invention is administered quarterly (i.e., about every three months). In other embodiments of the invention, a single dose of the pharmaceutical compositions of the invention is administered twice per year (i.e., about once every six months).

The skilled artisan will appreciate that certain factors can influence the dosage and timing required to effectively treat a subject, including but not limited to mutations present in the subject, previous treatments, the general health or age of the subject, and other diseases present. Moreover, treatment of a subject with a prophylactically or therapeutically effective amount, as appropriate, of a composition can include a single treatment or a series of treatments.

The iRNA can be delivered in a manner to target a particular tissue (e.g., hepatocytes).

Pharmaceutical compositions of the present invention include, but are not limited to, solutions, emulsions, and liposome-containing formulations. These compositions can be generated from a variety of components that include, but are not limited to, preformed liquids, self-emulsifying solids, and self-emulsifying semisolids. Formulations include those that target the liver.

The pharmaceutical formulations of the present invention, which can conveniently be presented in unit dosage form, can be prepared according to conventional techniques well known in the pharmaceutical industry. Such techniques include the step of bringing into association the active ingredients with the pharmaceutical carrier(s) or excipient (s). In general, the formulations are prepared by uniformly and intimately bringing into association the active ingredients with liquid carriers.

A. Additional Formulations
i. Emulsions

The compositions of the present invention can be prepared and formulated as emulsions.

Emulsions are typically heterogeneous systems of one liquid dispersed in another in the form of droplets usually exceeding 0.1 µm in diameter (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions can be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions can contain additional components in addition to the dispersed phases, and the active drug which can be present as a solution either in the aqueous phase, oily phase or itself as a separate phase. Pharmaceutical excipients such as emulsifiers, stabilizers, dyes, and anti-oxidants can also be present in emulsions as needed. Pharmaceutical emulsions can also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Other means of stabilizing emulsions entail the use of emulsifiers that can be incorporated into either phase of the emulsion. Emulsifiers can broadly be classified into four categories: synthetic surfactants, naturally occurring emulsifiers, absorption bases, and finely dispersed solids (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199). Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants can be classified into different classes based on the nature of the hydrophilic group: nonionic, anionic, cationic, and amphoteric (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY Rieger, in Pharmaceutical Dosage Forms, Lieberman, Rieger and Banker (Eds.), 1988, Marcel Dekker, Inc., New York, N.Y., volume 1, p. 285).

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives, and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, NY, volume 1, p. 199).

The application of emulsion formulations via dermatological, oral, and parenteral routes, and methods for their manufacture have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Idson, in Pharmaceutical Dosage Forms, Lieberman, Rieger and Banker (Eds.), 1988, Marcel Dekker, Inc., New York, N.Y., volume 1, p. 199).

ii. Microemulsions

In one embodiment of the present invention, the compositions of iRNAs and nucleic acids are formulated as microemulsions. A microemulsion can be defined as a system of water, oil, and amphiphile which is a single optically isotropic and thermodynamically stable liquid solution (see e.g., Ansel's Pharmaceutical Dosage Forms and Drug Delivery Systems, Allen, L V., Popovich N G., and Ansel H C., 2004, Lippincott Williams & Wilkins (8th ed.), New York, NY; Rosoff, in Pharmaceutical Dosage Forms, Lieberman, Rieger and Banker (Eds.), 1988, Marcel Dekker, Inc., New York, N.Y., volume 1, p. 245). Typically microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215).

iii. Microparticles

An iRNA of the invention may be incorporated into a particle, e.g., a microparticle. Microparticles can be produced by spray-drying, but may also be produced by other methods including lyophilization, evaporation, fluid bed drying, vacuum drying, or a combination of these techniques.

iv. Penetration Enhancers

In one embodiment, the present invention employs various penetration enhancers to effect the efficient delivery of nucleic acids, particularly iRNAs, to the skin of animals. Most drugs are present in solution in both ionized and nonionized forms. However, usually only lipid soluble or lipophilic drugs readily cross cell membranes. It has been discovered that even non-lipophilic drugs can cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers can be classified as belonging to one of five broad categories, i.e., surfactants, fatty acids, bile salts, chelating agents, and non-chelating non-surfactants (see e.g., Malmsten, M. Surfactants and polymers in drug delivery, Informa Health Care, New York, NY, 2002; Lee et al., Critical Reviews in Therapeutic Drug Carrier Systems, 1991, p. 92). Each of the above mentioned classes of penetration enhancers and their use in manufacture of pharmaceutical compositions and delivery of pharmaceutical agents are well known in the art.

v. Excipients

In contrast to a carrier compound, a "pharmaceutical carrier" or "excipient" is a pharmaceutically acceptable solvent, suspending agent, or any other pharmacologically inert vehicle for delivering one or more nucleic acids to an animal. The excipient can be liquid or solid and is selected, with the planned manner of administration in mind, so as to provide for the desired bulk, consistency, etc., when combined with a nucleic acid and the other components of a given pharmaceutical composition. Such agent are well known in the art.

vi. Other Components

The compositions of the present invention can additionally contain other adjunct components conventionally found in pharmaceutical compositions, at their art-established usage levels. Thus, for example, the compositions can contain additional, compatible, pharmaceutically-active materials such as, for example, antipruritics, astringents, local anesthetics or anti-inflammatory agents, or can contain additional materials useful in physically formulating various dosage forms of the compositions of the present invention, such as dyes, flavoring agents, preservatives, antioxidants, opacifiers, thickening agents and stabilizers. However, such materials, when added, should not unduly interfere with the biological activities of the components of the compositions of the present invention. The formulations can be sterilized and, if desired, mixed with auxiliary agents, e.g., lubricants, preservatives, stabilizers, wetting agents, emulsifiers, salts for influencing osmotic pressure, buffers, colorings, flavorings, or aromatic substances, and the like which do not deleteriously interact with the nucleic acid(s) of the formulation.

Aqueous suspensions can contain substances which increase the viscosity of the suspension including, for example, sodium carboxymethylcellulose, sorbitol, or dextran. The suspension can also contain stabilizers.

In some embodiments, pharmaceutical compositions featured in the invention include (a) one or more iRNA and (b) one or more agents which function by a non-iRNA mechanism and which are useful in treating a complement factor B-associated disorder.

Toxicity and prophylactic efficacy of such compounds can be determined by standard pharmaceutical procedures in cell cultures or experimental animals, e.g., for determining the LD50 (the dose lethal to 50% of the population) and the ED50 (the dose prophylactically effective in 50% of the population). The dose ratio between toxic and therapeutic effects is the therapeutic index and it can be expressed as the ratio LD50/ED50. Compounds that exhibit high therapeutic indices are preferred.

The data obtained from cell culture assays and animal studies can be used in formulating a range of dosage for use in humans. The dosage of compositions featured herein in the invention lies generally within a range of circulating concentrations that include the ED50, such as an ED80 or ED90, with little or no toxicity. The dosage can vary within this range depending upon the dosage form employed and the route of administration utilized. For any compound used in the methods featured in the invention, the prophylactically effective dose can be estimated initially from cell culture assays. A dose can be formulated in animal models to achieve a circulating plasma concentration range of the compound or, when appropriate, of the polypeptide product of a target sequence (e.g., achieving a decreased concentration of the polypeptide) that includes the IC50 (i.e., the concentration of the test compound which achieves a half-maximal inhibition of symptoms) or higher levels of inhibition as determined in cell culture. Such information can be used to more accurately determine useful doses in humans. Levels in plasma can be measured, for example, by high performance liquid chromatography.

In addition to their administration, as discussed above, the iRNAs featured in the invention can be administered in combination with other known agents used for the prevention or treatment of a complement factor B-associated disorder. In any event, the administering physician can adjust the amount and timing of iRNA administration on the basis of results observed using standard measures of efficacy known in the art or described herein.

VI. Methods for Inhibiting Complement Factor B Expression

The present invention also provides methods of inhibiting expression of a CFB gene in a cell. The methods include contacting a cell with an RNAi agent, e.g., double stranded RNA agent, in an amount effective to inhibit expression of CFB in the cell, thereby inhibiting expression of CFB in the cell.

Contacting of a cell with an iRNA, e.g., a double stranded RNA agent, may be done in vitro or in vivo. Contacting a cell in vivo with the iRNA includes contacting a cell or group of cells within a subject, e.g., a human subject, with the iRNA. Combinations of in vitro and in vivo methods of contacting a cell are also possible. Contacting a cell may be direct or indirect, as discussed above. Furthermore, contacting a cell may be accomplished via a targeting ligand, including any ligand described herein or known in the art. In certain embodiments, the targeting ligand is a carbohydrate moiety, e.g., a GalNAc ligand, or any other ligand that directs the RNAi agent to a site of interest.

The term "inhibiting," as used herein, is used interchangeably with "reducing," "silencing," "downregulating", "suppressing", and other similar terms, and includes any level of inhibition.

The phrase "inhibiting expression of a complement factor B gene" is intended to refer to inhibition of expression of any complement factor B gene (such as, e.g., a mouse complement factor B gene, a rat complement factor B gene, a monkey complement factor B gene, or a human complement factor B gene) as well as variants or mutants of a complement factor B gene. Thus, the complement factor B gene may be a wild-type complement factor B gene, a mutant complement factor B gene, or a transgenic complement factor B gene in the context of a genetically manipulated cell, group of cells, or organism.

"Inhibiting expression of a complement factor B gene" includes any level of inhibition of a complement factor B gene, e.g., at least partial suppression of the expression of a complement factor B gene, such as a clinically relevant level of suppression. The expression of the complement factor B gene may be assessed based on the level, or the change in the level, of any variable associated with complement factor B gene expression, e.g., complement factor B mRNA level or complement factor B protein level, or, for example, $CH_{50}$ activity as a measure of total hemolytic complement, $AH_{50}$ to measure the hemolytic activity of the alternate pathway of complement, or lactate dehydrogenase (LDH) levels as a measure of intravascular hemolysis, or hemoglobin levels. Levels of C3, C9, C5, C5a, C5b, and soluble C5b-9 complex may also be measured to assess CFB expression. Inhibition may be assessed by a decrease in an absolute or relative level of one or more of these variables compared with a control level. This level may be assessed in an individual cell or in a group of cells, including, for example, a sample derived from a subject. It is understood that complement factor B is expressed predominantly in the liver, and is present in circulation.

Inhibition may be assessed by a decrease in an absolute or relative level of one or more variables that are associated with complement factor B expression compared with a control level. The control level may be any type of control level that is utilized in the art, e.g., a pre-dose baseline level, or a level determined from a similar subject, cell, or sample that is untreated or treated with a control (such as, e.g., buffer only control or inactive agent control).

In some embodiments of the methods of the invention, expression of a complement factor B gene is inhibited by at least 50%, 55%, 60%, 65%, 70%, 75%, 80%, 85%, 90%, or 95%, or to below the level of detection of the assay. In certain embodiments, expression of a complement factor B gene is inhibited by at least 70%. It is further understood that inhibition of complement factor B expression in certain tissues, e.g., in gall bladder, without a significant inhibition of expression in other tissues, e.g., brain, may be desirable. In certain embodiments, expression level is determined using the assay method provided in Example 2 with a 10 nM siRNA concentration in the appropriate species matched cell line.

In certain embodiments, inhibition of expression in vivo is determined by knockdown of the human gene in a rodent expressing the human gene, e.g., an AAV-infected mouse expressing the human target gene (i.e., complement factor B), e.g., when administered as a single dose, e.g., at 3 mg/kg at the nadir of RNA expression. Knockdown of expression of an endogenous gene in a model animal system can also be determined, e.g., after administration of a single dose at, e.g., 3 mg/kg at the nadir of RNA expression. Such systems are useful when the nucleic acid sequence of the human gene and the model animal gene are sufficiently close such that the human iRNA provides effective knockdown of the model animal gene. RNA expression in liver is determined using the PCR methods provided in Example 2.

Inhibition of the expression of a complement factor B gene may be manifested by a reduction of the amount of mRNA expressed by a first cell or group of cells (such cells may be present, for example, in a sample derived from a subject) in which a complement factor B gene is transcribed and which has or have been treated (e.g., by contacting the cell or cells with an iRNA of the invention, or by administering an iRNA of the invention to a subject in which the cells are or were present) such that the expression of a complement factor B gene is inhibited, as compared to a second cell or group of cells substantially identical to the first cell or group of cells but which has not or have not been so treated (control cell(s) not treated with an iRNA or not treated with an iRNA targeted to the gene of interest). In certain embodiments, the inhibition is assessed by the method provided in Example 2 using a 10 nM siRNA concentration in the species matched cell line and expressing the level of mRNA in treated cells as a percentage of the level of mRNA in control cells, using the following formula:

$$\frac{(mRNA \text{ in control cells}) - (mRNA \text{ in treated cells})}{(mRNA \text{ in control cells})} \cdot 100\%$$

In other embodiments, inhibition of the expression of a complement factor B gene may be assessed in terms of a reduction of a parameter that is functionally linked to complement factor B gene expression, e.g., complement factor B protein level in blood or serum from a subject. Complement factor B gene silencing may be determined in any cell expressing complement factor B, either endogenous or heterologous from an expression construct, and by any assay known in the art.

Inhibition of the expression of a complement factor B protein may be manifested by a reduction in the level of the complement factor B protein that is expressed by a cell or group of cells or in a subject sample (e.g., the level of protein in a blood sample derived from a subject). As explained above, for the assessment of mRNA suppression, the inhibition of protein expression levels in a treated cell or group of cells may similarly be expressed as a percentage of the level of protein in a control cell or group of cells, or the change in the level of protein in a subject sample, e.g., blood or serum derived therefrom.

A control cell, a group of cells, or subject sample that may be used to assess the inhibition of the expression of a complement factor B gene includes a cell, group of cells, or subject sample that has not yet been contacted with an RNAi agent of the invention. For example, the control cell, group of cells, or subject sample may be derived from an individual subject (e.g., a human or animal subject) prior to treatment of the subject with an RNAi agent or an appropriately matched population control.

The level of complement factor B mRNA that is expressed by a cell or group of cells may be determined using any method known in the art for assessing mRNA expression. In one embodiment, the level of expression of complement factor B in a sample is determined by detecting a transcribed polynucleotide, or portion thereof, e.g., mRNA of the complement factor B gene. RNA may be extracted from cells using RNA extraction techniques including, for example, using acid phenol/guanidine isothiocyanate extraction (RNAzol B; Biogenesis), RNeasy™ RNA preparation kits (Qiagen®) or PAXgene™ (PreAnalytix™, Switzerland). Typical assay formats utilizing ribonucleic acid hybridization include nuclear run-on assays, RT-PCR, RNase protection assays, northern blotting, in situ hybridization, and microarray analysis.

In some embodiments, the level of expression of complement factor B is determined using a nucleic acid probe. The term "probe", as used herein, refers to any molecule that is capable of selectively binding to a specific complement factor B. Probes can be synthesized by one of skill in the art, or derived from appropriate biological preparations. Probes may be specifically designed to be labeled. Examples of molecules that can be utilized as probes include, but are not limited to, RNA, DNA, proteins, antibodies, and organic molecules.

Isolated mRNA can be used in hybridization or amplification assays that include, but are not limited to, Southern or northern analyses, polymerase chain reaction (PCR) analyses and probe arrays. One method for the determination of mRNA levels involves contacting the isolated mRNA with a nucleic acid molecule (probe) that can hybridize to complement factor B mRNA. In one embodiment, the mRNA is immobilized on a solid surface and contacted with a probe, for example by running the isolated mRNA on an agarose gel and transferring the mRNA from the gel to a membrane, such as nitrocellulose. In an alternative embodiment, the probe(s) are immobilized on a solid surface and the mRNA is contacted with the probe(s), for example, in an Affymetrix® gene chip array. A skilled artisan can readily adapt known mRNA detection methods for use in determining the level of complement factor B mRNA.

An alternative method for determining the level of expression of complement factor B in a sample involves the process of nucleic acid amplification or reverse transcriptase (to prepare cDNA) of for example mRNA in the sample, e.g., by RT-PCR (the experimental embodiment set forth in Mullis, 1987, U.S. Pat. No. 4,683,202), ligase chain reaction (Barany (1991) *Proc. Natl. Acad. Sci. USA* 88:189-193), self sustained sequence replication (Guatelli et al. (1990) *Proc. Natl. Acad. Sci. USA* 87:1874-1878), transcriptional amplification system (Kwoh et al. (1989) *Proc. Natl. Acad. Sci. USA* 86:1173-1177), Q-Beta Replicase (Lizardi et al. (1988) *Bio/Technology* 6:1197), rolling circle replication (Lizardi et al., U.S. Pat. No. 5,854,033) or any other nucleic acid amplification method, followed by the detection of the amplified molecules using techniques well known to those of skill in the art. These detection schemes are especially useful for the detection of nucleic acid molecules if such molecules are present in very low numbers. In particular aspects of the invention, the level of expression of CFB is determined by quantitative fluorogenic RT-PCR (i.e., the TaqMan™ System). In certain embodiments, expression level is determined by the method provided in Example 2 using, e.g., a 10 nM siRNA concentration, in the species matched cell line.

The expression levels of complement factor B mRNA may be monitored using a membrane blot (such as used in hybridization analysis such as northern, Southern, dot, and the like), or microwells, sample tubes, gels, beads or fibers (or any solid support comprising bound nucleic acids). See U.S. Pat. Nos. 5,770,722, 5,874,219, 5,744,305, 5,677,195 and 5,445,934, which are incorporated herein by reference. The determination of complement factor B expression level may also comprise using nucleic acid probes in solution.

In certain embodiments, the level of mRNA expression is assessed using branched DNA (bDNA) assays or real time PCR (qPCR). The use of these methods is described and exemplified in the Examples presented herein. In certain embodiments, expression level is determined by the method provided in Example 2 using a 10 nM siRNA concentration in the species matched cell line.

The level of CFB protein expression may be determined using any method known in the art for the measurement of protein levels. Such methods include, for example, electrophoresis, capillary electrophoresis, high performance liquid chromatography (HPLC), thin layer chromatography (TLC), hyperdiffusion chromatography, fluid or gel precipitin reactions, absorption spectroscopy, a colorimetric assays, spectrophotometric assays, flow cytometry, immunodiffusion (single or double), immunoelectrophoresis, western blotting, radioimmunoassay (RIA), enzyme-linked immunosorbent assays (ELISAs), immunofluorescent assays, electrochemiluminescence assays, and the like.

In some embodiments, the efficacy of the methods of the invention is assessed by a decrease in CFB mRNA or protein level (e.g., in a liver biopsy).

In some embodiments of the methods of the invention, the iRNA is administered to a subject such that the iRNA is delivered to a specific site within the subject. The inhibition of expression of complement factor B may be assessed using measurements of the level or change in the level of complement factor B mRNA or complement factor B protein in a sample derived from fluid or tissue from the specific site within the subject (e.g., liver or blood).

As used herein, the terms detecting or determining a level of an analyte are understood to mean performing the steps to determine if a material, e.g., protein, RNA, is present. As used herein, methods of detecting or determining include detection or determination of an analyte level that is below the level of detection for the method used.

VII. Prophylactic and Treatment Methods of the Invention

The present invention also provides methods of using an iRNA of the invention or a composition containing an iRNA of the invention to inhibit expression of complement factor B, thereby preventing or treating a complement factor B-associated disorder, e.g., paroxysmal nocturnal hemoglobinuria (PNH), atypical hemolytic uremic syndrome (aHUS), asthma, rheumatoid arthritis (RA); antiphospholipid antibody syndrome; lupus nephritis; ischemia-reperfusion injury; typical or infectious hemolytic uremic syndrome (tHUS); dense deposit disease (DDD); neuromyelitis optica (NMO); multifocal motor neuropathy (MMN); multiple sclerosis (MS); macular degeneration (e.g., age-related macular degeneration (AMD)); hemolysis, elevated liver enzymes, and low platelets (HELLP) syndrome; thrombotic thrombocytopenic purpura (TTP); spontaneous fetal loss; Pauci-immune vasculitis; epidermolysis bullosa; recurrent fetal loss; pre-eclampsia, traumatic brain injury, myasthenia gravis, cold agglutinin disease, dermatomyositis bullous pemphigoid, Shiga toxin *E. coli*-related hemolytic uremic syndrome, C3 neuropathy, anti-neutrophil cytoplasmic antibody-associated vasculitis (e.g., granulomatosis with polyangiitis (previously known as Wegener granulomatosis), Churg-Strauss syndrome, and microscopic polyangiitis), humoral and vascular transplant rejection, graft dysfunction, myocardial infarction (e.g., tissue damage and ischemia in myocardial infarction), an allogenic transplant, sepsis (e.g., poor outcome in sepsis), Coronary artery disease, dermatomyositis, Graves' disease, atherosclerosis, Alzheimer's disease, systemic inflammatory response sepsis, septic shock, spinal cord injury, glomerulonephritis, Hashimoto's thyroiditis, type I diabetes, psoriasis, pemphigus, autoimmune hemolytic anemia (AIHA), ITP, Goodpasture syndrome, Degos disease, antiphospholipid syndrome (APS), catastrophic APS (CAPS), a cardiovascular disorder, myocarditis, a cerebrovascular disorder, a peripheral (e.g., musculoskeletal) vascular disorder, a renovascular disorder, a mesenteric/enteric vascular disorder, vasculitis, Henoch-Schönlein purpura nephritis, systemic lupus erythematosus-associated vasculitis, vasculitis associated with rheumatoid arthritis, immune complex vasculitis, Takayasu's disease, dilated cardiomyopathy, diabetic angiopathy, Kawasaki's disease (arteritis), venous gas embolus (VGE), and restenosis following stent placement, rotational atherectomy, and percutaneous transluminal coronary angioplasty (PTCA) (see, e.g., Holers (2008) *Immunological Reviews* 223:300-316; Holers and Thurman (2004) *Molecular Immunology* 41:147-152; U.S. Patent Publication No. 20070172483).

In one embodiment, the complement factor B-associate disease is selected from the group consisting of C3 glomerulopathy, systemic lupus erythematosus (SLE), e.g., Lupus Nephritis, IgA nephropathy, diabetic nephropathy, polycystic kidney disease, membranous nephropathy, age-related macular degeneration, atypical hemolytic uremic syndrome, thrombotic microangiopathy, myasthenia gravis, ischemia and reperfusion injury, paroxysmal nocturnal hemoglobinuria, and rheumatoid arthritis In another embodiment, the complement factor B-associate disease is selected from the group consisting of C3 glomerulopathy, systemic lupus erythematosus (SLE), e.g., Lupus Nephritis, IgA nephropathy, diabetic nephropathy, and polycystic kidney disease.

In the methods of the invention the cell may be contacted with the siRNA in vitro or in vivo, i.e., the cell may be within a subject.

A cell suitable for treatment using the methods of the invention may be any cell that expresses a complement factor B gene, e.g., a liver cell, a brain cell, a gall bladder cell, a heart cell, or a kidney cell. In one embodiment, the cell is a liver cell. A cell suitable for use in the methods of the invention may be a mammalian cell, e.g., a primate cell (such as a human cell, including human cell in a chimeric non-human animal, or a non-human primate cell, e.g., a monkey cell or a chimpanzee cell), or a non-primate cell. In certain embodiments, the cell is a human cell, e.g., a human liver cell. In the methods of the invention, complement factor B expression is inhibited in the cell by at least 50, 55, 60, 65, 70, 75, 80, 85, 90, or 95, or to a level below the level of detection of the assay.

The in vivo methods of the invention may include administering to a subject a composition containing an iRNA, where the iRNA includes a nucleotide sequence that is complementary to at least a part of an RNA transcript of the complement factor B gene of the mammal to which the RNAi agent is to be administered. The composition can be administered by any means known in the art including, but not limited to oral, intraperitoneal, or parenteral routes, including intracranial (e.g., intraventricular, intraparenchymal, and intrathecal), intravenous, intramuscular, subcutaneous, transdermal, airway (aerosol), nasal, rectal, and topical (including buccal and sublingual) administration. In certain embodiments, the compositions are administered by intravenous infusion or injection. In certain embodiments, the compositions are administered by subcutaneous injection. In certain embodiments, the compositions are administered by intramuscular injection.

In some embodiments, the administration is via a depot injection. A depot injection may release the iRNA in a consistent way over a prolonged time period. Thus, a depot injection may reduce the frequency of dosing needed to obtain a desired effect, e.g., a desired inhibition of CFB, or a therapeutic or prophylactic effect. A depot injection may also provide more consistent serum concentrations. Depot injections may include subcutaneous injections or intramuscular injections. In certain embodiments, the depot injection is a subcutaneous injection.

In some embodiments, the administration is via a pump. The pump may be an external pump or a surgically implanted pump. In certain embodiments, the pump is a subcutaneously implanted osmotic pump. In other embodiments, the pump is an infusion pump. An infusion pump may be used for intravenous, subcutaneous, arterial, or epidural infusions. In certain embodiments, the infusion pump is a subcutaneous infusion pump. In other embodiments, the pump is a surgically implanted pump that delivers the iRNA to the liver.

The mode of administration may be chosen based upon whether local or systemic treatment is desired and based upon the area to be treated. The route and site of administration may be chosen to enhance targeting.

In one aspect, the present invention also provides methods for inhibiting the expression of a complement factor B gene in a mammal. The methods include administering to the mammal a composition comprising a dsRNA that targets a complement factor B gene in a cell of the mammal and maintaining the mammal for a time sufficient to obtain degradation of the mRNA transcript of the complement factor B gene, thereby inhibiting expression of the complement factor B gene in the cell. Reduction in gene expression can be assessed by any methods known in the art and by methods, e.g. qRT-PCR, described herein, e.g., in Example 2. Reduction in protein production can be assessed by any methods known it the art, e.g. ELISA. In certain embodiments, a puncture liver biopsy sample serves as the tissue material for monitoring the reduction in the complement factor B gene or protein expression. In other embodiments, a blood sample serves as the subject sample for monitoring the reduction in the complement factor B protein expression.

The present invention further provides methods of treatment in a subject in need thereof, e.g., a subject diagnosed with a complement factor B-associated disorder, such as, C3 glomerulopathy, systemic lupus erythematosus (SLE), e.g., Lupus Nephritis, IgA nephropathy, diabetic nephropathy, and polycystic kidney disease.

The present invention further provides methods of prophylaxis in a subject in need thereof. The treatment methods of the invention include administering an iRNA of the invention to a subject, e.g., a subject that would benefit from a reduction of complement factor B expression, in a prophylactically effective amount of an iRNA targeting a complement factor B gene or a pharmaceutical composition comprising an iRNA targeting a complement factor B gene.

In one embodiment, a complement factor B-associated disease is selected from the group consisting of paroxysmal nocturnal hemoglobinuria (PNH), atypical hemolytic uremic syndrome (aHUS), asthma, rheumatoid arthritis (RA); antiphospholipid antibody syndrome; lupus nephritis; ischemia-reperfusion injury; typical or infectious hemolytic uremic syndrome (tHUS); dense deposit disease (DDD); neuromyelitis optica (NMO); multifocal motor neuropathy (MMN); multiple sclerosis (MS); macular degeneration (e.g., age-related macular degeneration (AMD)); hemolysis, elevated liver enzymes, and low platelets (HELLP) syndrome; thrombotic thrombocytopenic purpura (TTP); spontaneous fetal loss; Pauci-immune vasculitis; epidermolysis bullosa; recurrent fetal loss; pre-eclampsia, traumatic brain injury, myasthenia gravis, cold agglutinin disease, dermatomyositis bullous pemphigoid, Shiga toxin *E. coli*-related hemolytic uremic syndrome, C3 neuropathy, anti-neutrophil cytoplasmic antibody-associated vasculitis (e.g., granulomatosis with polyangiitis (previously known as Wegener granulomatosis), Churg-Strauss syndrome, and microscopic polyangiitis), humoral and vascular transplant rejection, graft dysfunction, myocardial infarction (e.g., tissue damage and ischemia in myocardial infarction), an allogenic transplant, sepsis (e.g., poor outcome in sepsis), Coronary artery disease, dermatomyositis, Graves' disease, atherosclerosis, Alzheimer's disease, systemic inflammatory response sepsis, septic shock, spinal cord injury, glomerulonephritis, Hashimoto's thyroiditis, type I diabetes, psoriasis, pemphigus, autoimmune hemolytic anemia (AIHA), ITP, Goodpasture syndrome, Degos disease, antiphospholipid syndrome (APS), catastrophic APS (CAPS), a cardiovascular disorder, myocarditis, a cerebrovascular disorder, a peripheral (e.g., musculoskeletal) vascular disorder, a renovascular disorder, a mesenteric/enteric vascular disorder, vasculitis, Henoch-Schönlein purpura nephritis, systemic lupus erythematosus-associated vasculitis, vasculitis associated with rheumatoid arthritis, immune complex vasculitis, Takayasu's disease, dilated cardiomyopathy, diabetic angiopathy, Kawasaki's disease (arteritis), venous gas embolus (VGE), and restenosis following stent placement, rotational atherectomy, and percutaneous transluminal coronary angioplasty (PTCA) (see, e.g., Holers (2008) *Immunological Reviews* 223:300-316; Holers and Thurman (2004) *Molecular Immunology* 41:147-152; US20070172483).

In one embodiment, the complement factor B-associate disease is selected from the group consisting of C3 glomerulopathy, systemic lupus erythematosus (SLE), e.g., Lupus Nephritis, IgA nephropathy, diabetic nephropathy, polycystic kidney disease, membranous nephropathy, age-related macular degeneration, atypical hemolytic uremic syndrome, thrombotic microangiopathy, myasthenia gravis, ischemia and reperfusion injury, paroxysmal nocturnal hemoglobinuria, and rheumatoid arthritis In another embodiment, the complement factor B-associate disease is selected from the group consisting of C3 glomerulopathy, systemic lupus erythematosus (SLE), e.g., Lupus Nephritis, IgA nephropathy, diabetic nephropathy, and polycystic kidney disease.

An iRNA of the invention may be administered as a "free iRNA." A free iRNA is administered in the absence of a pharmaceutical composition. The naked iRNA may be in a suitable buffer solution. The buffer solution may comprise acetate, citrate, prolamine, carbonate, or phosphate, or any combination thereof. In one embodiment, the buffer solution is phosphate buffered saline (PBS). The pH and osmolarity of the buffer solution containing the iRNA can be adjusted such that it is suitable for administering to a subject.

Alternatively, an iRNA of the invention may be administered as a pharmaceutical composition, such as a dsRNA liposomal formulation.

Subjects that would benefit from an inhibition of complement factor B gene expression are subjects susceptible to or diagnosed with a CFB-associated disorder, e.g., C3 glomerulopathy, systemic lupus erythematosus (SLE), e.g., Lupus Nephritis, IgA nephropathy, diabetic nephropathy, and polycystic kidney disease.

In an embodiment, the method includes administering a composition featured herein such that expression of the target complement component B gene is decreased, such as for about 1, 2, 3, 4, 5, 6, 1-6, 1-3, or 3-6 months per dose. In certain embodiments, the composition is administered once every 3-6 months.

In one embodiment, the iRNAs useful for the methods and compositions featured herein specifically target RNAs (primary or processed) of the target complement factor B gene. Compositions and methods for inhibiting the expression of these genes using iRNAs can be prepared and performed as described herein.

Administration of the iRNA according to the methods of the invention may result prevention or treatment of a complement factor B-associated disorder, e.g., C3 glomerulopathy, systemic lupus erythematosus (SLE), e.g., Lupus Nephritis, IgA nephropathy, diabetic nephropathy, and polycystic kidney disease.

Subjects can be administered a therapeutic amount of iRNA, such as about 0.01 mg/kg to about 200 mg/kg. Subjects can be administered a therapeutic amount of iRNA, such as about 5 mg to about 1000 mg as a fixed dose, regardless of body weight.

In some embodiment, the iRNA is administered subcutaneously, i.e., by subcutaneous injection. One or more injections may be used to deliver the desired dose of iRNA to a subject. The injections may be repeated over a period of time.

The administration may be repeated on a regular basis. In certain embodiments, after an initial treatment regimen, the treatments can be administered on a less frequent basis. A repeat-dose regimen may include administration of a therapeutic amount of iRNA on a regular basis, such as once per month to once a year. In certain embodiments, the iRNA is administered about once per month to about once every three months, or about once every three months to about once every six months.

The invention further provides methods and uses of an iRNA agent or a pharmaceutical composition thereof for treating a subject that would benefit from reduction or inhibition of CFB gene expression, e.g., a subject having a CFB-associated disease, in combination with other pharmaceuticals or other therapeutic methods, e.g., with known pharmaceuticals or known therapeutic methods, such as, for example, those which are currently employed for treating these disorders.

Accordingly, in some aspects of the invention, the methods which include either a single iRNA agent of the invention, further include administering to the subject one or more additional therapeutic agents. The iRNA agent and an additional therapeutic agent or treatment may be administered at the same time or in the same combination, e.g., parenterally, or the additional therapeutic agent can be administered as part of a separate composition or at separate times or by another method known in the art or described herein.

In one embodiment, an iRNA agent of the invention is administered in combination with an anti-complement component C5 antibody, or antigen-binding fragment thereof (e.g., eculizumab or ravulizumab-cwvz), an iRNA agent targeting complement component C5, an iRNA agent targeting complement component C3, or a C3 peptide inhibitor (e.g., compstatin). In one embodiment, the iRNA agent of the invention is administered to the patient, and then the additional therapeutic agent is administered to the patient (or vice versa). In another embodiment, the iRNA agent of the invention and the additional therapeutic agent are administered at the same time.

The iRNA agent of the invention and an additional therapeutic agent or treatment may be administered at the same time or in the same combination, e.g., parenterally, or the additional therapeutic agent can be administered as part of a separate composition or at separate times or by another method known in the art or described herein.

VIII. Kits

In certain aspects, the instant disclosure provides kits that include a suitable container containing a pharmaceutical formulation of a siRNA compound, e.g., a double-stranded siRNA compound, or ssiRNA compound, (e.g., a precursor, e.g., a larger siRNA compound which can be processed into a ssiRNA compound, or a DNA which encodes an siRNA compound, e.g., a double-stranded siRNA compound, or ssiRNA compound, or precursor thereof).

Such kits include one or more dsRNA agent(s) and instructions for use, e.g., instructions for administering a prophylactically or therapeutically effective amount of a dsRNA agent(s). The dsRNA agent may be in a vial or a pre-filled syringe. The kits may optionally further comprise means for administering the dsRNA agent (e.g., an injection device, such as a pre-filled syringe), or means for measuring the inhibition of CFB (e.g., means for measuring the inhibition of CFB mRNA, CFB protein, or CFB activity). Such means for measuring the inhibition of CFB may comprise a means for obtaining a sample from a subject, such as, e.g., a plasma sample. The kits of the invention may optionally further comprise means for determining the therapeutically effective or prophylactically effective amount.

In certain embodiments the individual components of the pharmaceutical formulation may be provided in one container, e.g., a vial or a pre-filled syringe. Alternatively, it may be desirable to provide the components of the pharmaceutical formulation separately in two or more containers, e.g., one container for a siRNA compound preparation, and at least another for a carrier compound. The kit may be packaged in a number of different configurations such as one or more containers in a single box. The different components can be combined, e.g., according to instructions provided with the kit. The components can be combined according to a method described herein, e.g., to prepare and administer a pharmaceutical composition. The kit can also include a delivery device.

This invention is further illustrated by the following examples which should not be construed as limiting. The entire contents of all publications, patents and published patent applications cited throughout this application, as well as the informal Sequence Listing and Figures, are hereby incorporated herein by reference.

EXAMPLES

Example 1. iRNA Synthesis

Source of Reagents

Where the source of a reagent is not specifically given herein, such reagent can be obtained from any supplier of reagents for molecular biology at a quality/purity standard for application in molecular biology.

siRNA Design siRNAs targeting the human complement factor B (CFB) gene, (human: NCBI refseqID NM_001710.6; NCBI GeneID: 629) was designed using custom Rand Python scripts. The human NM_001710 REFSEQ mRNA, version 6, has a length of 2476 bases. Detailed lists of the unmodified CFB sense and antisense strand nucleotide sequences are shown in Table 2. Detailed lists of the modified CFB sense and antisense strand nucleotide sequences are shown in Table 3.

It is to be understood that, throughout the application, a duplex name without a decimal is equivalent to a duplex name with a decimal which merely references the batch number of the duplex. For example, AD-959917 is equivalent to AD-959917.1.

siRNA Synthesis siRNAs were synthesized and annealed using routine methods known in the art.

Briefly, siRNA sequences were synthesized on a 1 μmol scale using a Mermade 192 synthesizer (BioAutomation) with phosphoramidite chemistry on solid supports. The solid support was controlled pore glass (500-1000 Å) loaded with a custom GalNAc ligand (3'-GalNAc conjugates), universal solid support (AM Chemicals), or the first nucleotide of interest. Ancillary synthesis reagents and standard 2-cyanoethyl phosphoramidite monomers (2'-deoxy-2'-fluoro, 2'-O-methyl, RNA, DNA) were obtained from Thermo-Fisher (Milwaukee, WI), Hongene (China), or Chemgenes (Wilmington, MA, USA). Additional phosphoramidite monomers were procured from commercial suppliers, prepared in-house, or procured using custom synthesis from various CMOs. Phosphoramidites were prepared at a concentration of 100 mM in either acetonitrile or 9:1 acetonitrile:DMF and were coupled using 5-Ethylthio-1H-tetrazole (ETT, 0.25 M in acetonitrile) with a reaction time of 400 s. Phosphorothioate linkages were generated using a 100 mM solution of 3-((Dimethylamino-methylidene) amino)-3H-1,2,4-dithiazole-3-thione (DDTT, obtained from Chemgenes (Wilmington, MA, USA)) in anhydrous acetonitrile/pyridine (9:1 v/v). Oxidation time was 5 minutes. All sequences were synthesized with final removal of the DMT group ("DMT-Off").

Upon completion of the solid phase synthesis, solid-supported oligoribonucleotides were treated with 300 μL of Methylamine (40% aqueous) at room temperature in 96 well plates for approximately 2 hours to afford cleavage from the solid support and subsequent removal of all additional base-labile protecting groups. For sequences containing any natural ribonucleotide linkages (2'-OH) protected with a tert-butyl dimethyl silyl (TBDMS) group, a second deprotection step was performed using TEA·3HF (triethylamine trihydrofluoride). To each oligonucleotide solution in aqueous methylamine was added 200 μL of dimethyl sulfoxide (DMSO) and 300 μL TEA·3HF and the solution was incubated for approximately 30 mins at 60° C. After incubation, the plate was allowed to come to room temperature and crude oligonucleotides were precipitated by the addition of 1 mL of 9:1 acetontrile:ethanol or 1:1 ethanol:isopropanol. The plates were then centrifuged at 4° C. for 45 mins and the supernatant carefully decanted with the aid of a multichannel pipette. The oligonucleotide pellet was resuspended in 20 mM NaOAc and subsequently desalted using a HiTrap size exclusion column (5 mL, GE Healthcare) on an Agilent LC system equipped with an autosampler, UV detector, conductivity meter, and fraction collector. Desalted samples were collected in 96 well plates and then analyzed by LC-MS and UV spectrometry to confirm identity and quantify the amount of material, respectively.

Duplexing of single strands was performed on a Tecan liquid handling robot. Sense and antisense single strands were combined in an equimolar ratio to a final concentration of 10 μM in 1×PBS in 96 well plates, the plate sealed, incubated at 100° C. for 10 minutes, and subsequently allowed to return slowly to room temperature over a period of 2-3 hours. The concentration and identity of each duplex was confirmed and then subsequently utilized for in vitro screening assays.

TABLE 1

Abbreviations of nucleotide monomers used in nucleic acid sequence representation. It will be understood that these monomers, when present in an oligonucleotide, are mutually linked by 5'-3'-phosphodiester bonds; and it is understood that when the nucleotide contains a 2'-fluoro modification, then the fluoro replaces the hydroxy at that position in the parent nucleotide (i.e., it is a 2'-deoxy-2'-fluoronucleotide). It is to be further understood that the nucleotide abbreviations in the table omit the 3'-phosphate (i.e., they are 3'-OH) when placed at the 3'-terminal position of an oligonucleotide.

| Abbreviation | Nucleotide(s) |
| --- | --- |
| A | Adenosine-3'-phosphate |
| Ab | beta-L-adenosine-3'-phosphate |
| Abs | beta-L-adenosine-3'-phosphorothioate |
| Af | 2'-fluoroadenosine-3'-phosphate |
| Afs | 2'-fluoroadenosine-3'-phosphorothioate |
| As | adenosine-3'-phosphorothioate |
| C | cytidine-3'-phosphate |
| Cb | beta-L-cytidine-3'-phosphate |
| Cbs | beta-L-cytidine-3'-phosphorothioate |
| Cf | 2'-fluorocytidine-3'-phosphate |
| Cfs | 2'-fluorocytidine-3'-phosphorothioate |
| Cs | cytidine-3'-phosphorothioate |
| G | guanosine-3'-phosphate |
| Gb | beta-L-guanosine-3'-phosphate |
| Gbs | beta-L-guanosine-3'-phosphorothioate |
| Gf | 2'-fluoroguanosine-3'-phosphate |
| Gfs | 2'-fluoroguanosine-3'-phosphorothioate |
| Gs | guanosine-3'-phosphorothioate |
| T | 5'-methyluridine-3'-phosphate |
| Tf | 2'-fluoro-5-methyluridine-3'-phosphate |
| Tfs | 2'-fluoro-5-methyluridine-3'-phosphorothioate |
| Ts | 5-methyluridine-3'-phosphorothioate |
| U | Uridine-3'-phosphate |
| Uf | 2'-fluorouridine-3'-phosphate |

TABLE 1-continued

Abbreviations of nucleotide monomers used in nucleic acid sequence representation. It will be understood that these monomers, when present in an oligonucleotide, are mutually linked by 5'-3'-phosphodiester bonds; and it is understood that when the nucleotide contains a 2'-fluoro modification, then the fluoro replaces the hydroxy at that position in the parent nucleotide (i.e., it is a 2'-deoxy-2'-fluoronucleotide). It is to be further understood that the nucleotide abbreviations in the table omit the 3'-phosphate (i.e., they are 3'-OH) when placed at the 3'-terminal position of an oligonucleotide.

| Abbreviation | Nucleotide(s) |
|---|---|
| Ufs | 2'-fluorouridine-3'-phosphorothioate |
| Us | uridine-3'-phosphorothioate |
| N | any nucleotide, modified or unmodified |
| a | 2'-O-methyladenosine-3'-phosphate |
| as | 2'-O-methyladenosine-3'-phosphorothioate |
| c | 2'-O-methylcytidine-3'-phosphate |
| cs | 2'-O-methylcytidine-3'-phosphorothioate |
| g | 2'-O-methylguanosine-3'-phosphate |
| gs | 2'-O-methylguanosine-3'-phosphorothioate |
| t | 2'-O-methyl-5-methyluridine-3'-phosphate |
| ts | 2'-O-methyl-5-methyluridine-3'-phosphorothioate |
| u | 2'-O-methyluridine-3'-phosphate |
| us | 2'-O-methyluridine-3'-phosphorothioate |
| S | phosphorothioate linkage |
| L96 | N-[tris(GalNAc-alkyl)-amidodecanoyl)]-4-hydroxyprolinol (Hyp-(GalNAc-alkyl)3) (2S,4R)-1-[29-[[2-(acetylamino)-2-deoxy-ß-D-galactopyranosyl]oxy]-14,14-bis[[3-[[3-[[5-[[2-(acetylamino)-2-deoxy-ß-D-galactopyranosyl]oxy]-1-oxopentyl]amino]propyl]amino]-3-oxopropoxy]methyl]-1,12,19,25-tetraoxo-16-oxa-13,20,24-triazanonacos-1-yl]-4-hydroxy-2-hydroxymethylpyrrolidine 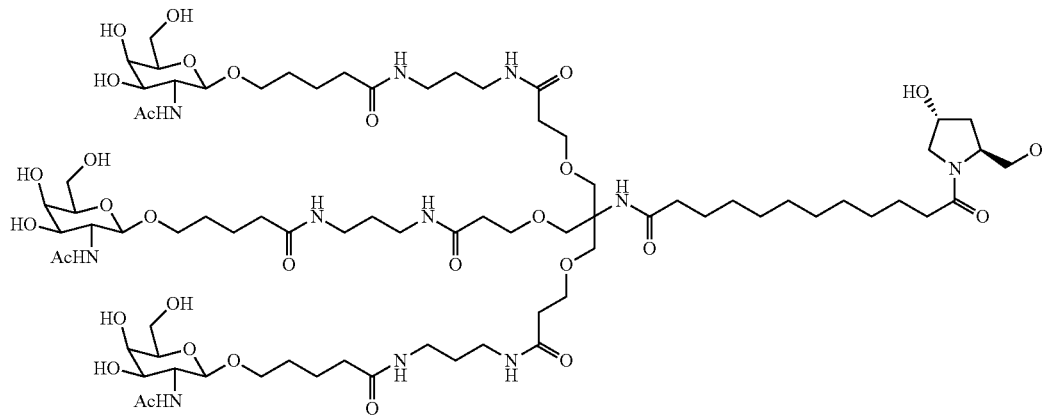 [SMILES: CC(=O)NC1C(OCCCCC(=O)NCCCNC(=O)CCOCC(COCCC(=O)NCCCNC(=O)CCCCOC2OC(CO)C(O)C(O)C2NC(C)=O)(COCCC(=O)NCCCNC(=O)CCCCOC2OC(CO)C(O)C(O)C2NC(C)=O)NC(=O)CCCCCCCCCCC(=O)N2C[C@H](O)C[C@H]2CO)OC(CO)C(O)C1O] |
| uL96 | 2'-O-methyluridine-3'-phosphate ((2S,4R)-1-[29-[[2-(acetylamino)-2-deoxy-ß-D-galactopyranosyl]oxy]-14,14-bis[[3-[[3-[[5-[[2-(acetylamino)-2-deoxy-ß-D-galactopyranosyl]oxy]-1-oxopentyl]amino]propyl]amino]-3-oxopropoxy]methyl]-1,12,19,25-tetraoxo-16-oxa-13,20,24-triazanonacos-1-yl]-4-hydroxy-2-pyrrolidinyl)methyl ester |

TABLE 1-continued

Abbreviations of nucleotide monomers used in nucleic acid sequence representation. It will be understood that these monomers, when present in an oligonucleotide, are mutually linked by 5'-3'-phosphodiester bonds; and it is understood that when the nucleotide contains a 2'-fluoro modification, then the fluoro replaces the hydroxy at that position in the parent nucleotide (i.e., it is a 2'-deoxy-2'-fluoronucleotide). It is to be further understood that the nucleotide abbreviations in the table omit the 3'-phosphate (i.e., they are 3'-OH) when placed at the 3'-terminal position of an oligonucleotide.

| Abbreviation | Nucleotide(s) |
|---|---|
| | 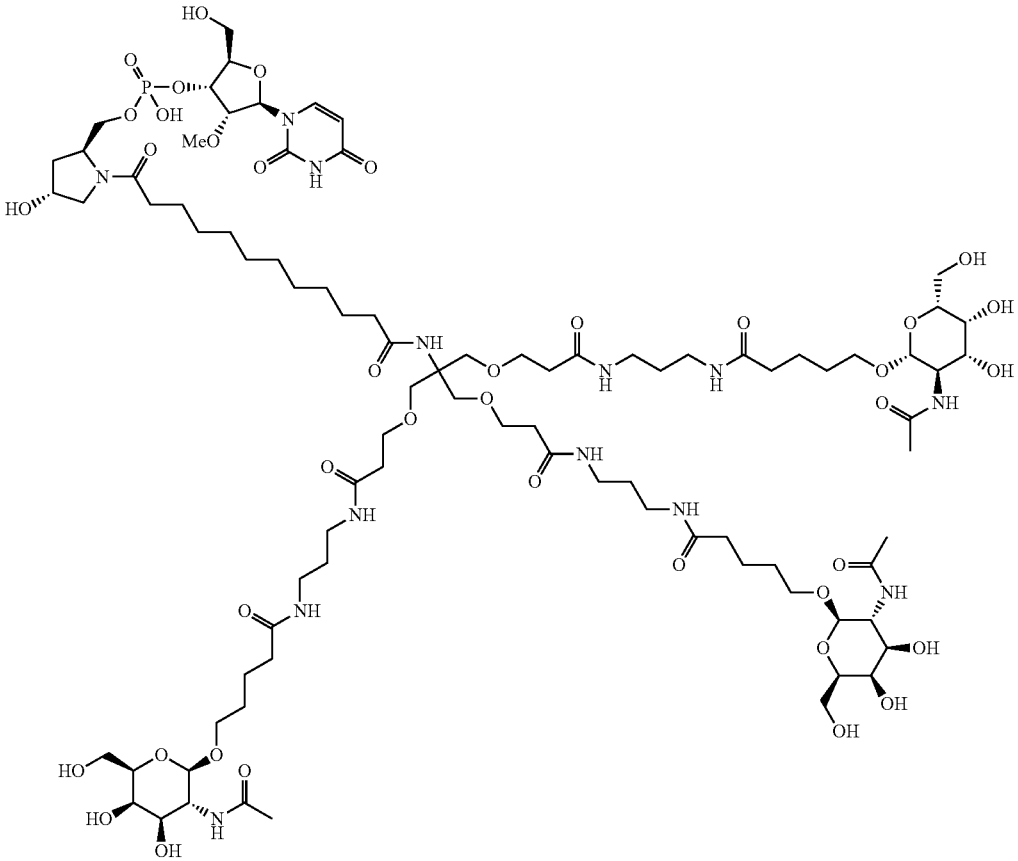 [SMILES: CO[C@@H]1[C@H](OP(=O)(O)OC[C@@H]2C[C@@H](O)CN2C(=O)CCCCCCCCCCC(=O)NC(COCCC(=O)NCCCNC(=O)CCCCO[C@@H]2O[C@H](CO)[C@H](O)[C@H](O)[C@H]2NC(C)=O)(COCCC(=O)NCCCNC(=O)CCCCO[C@@H]2O[C@H](CO)[C@H](O)[C@H](O)[C@H]2NC(C)=O)COCCC(=O)NCCCNC(=O)CCCCO[C@@H]2O[C@H](CO)[C@H](O)[C@H](O)[C@H]2NC(C)=O)[C@@H](CO)O[C@H]1n1ccc(=O)[nH]c1=O] |
| Y34 | 2-hydroxymethyl-tetrahydrofurane-4-methoxy-3-phosphate (abasic 2'-OMe furanose) 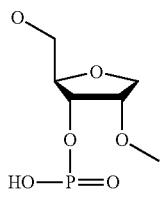 |
| Y44 | inverted abasic DNA (2-hydroxymethyl-tetrahydrofurane-5-phosphate) 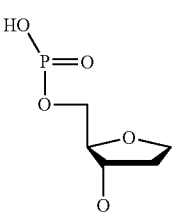 |
| L10 | N-(cholesterylcarboxamidocaproyl)-4-hydroxyprolinol (Hyp-C6-Chol) |

TABLE 1-continued

Abbreviations of nucleotide monomers used in nucleic acid sequence representation. It will be understood that these monomers, when present in an oligonucleotide, are mutually linked by 5'-3'-phosphodiester bonds; and it is understood that when the nucleotide contains a 2'-fluoro modification, then the fluoro replaces the hydroxy at that position in the parent nucleotide (i.e., it is a 2'-deoxy-2'-fluoronucleotide). It is to be further understood that the nucleotide abbreviations in the table omit the 3'-phosphate (i.e., they are 3'-OH) when placed at the 3'-terminal position of an oligonucleotide.

| Abbreviation | Nucleotide(s) |
| --- | --- |
| (Agn) | Adenosine-glycol nucleic acid (GNA) S-Isomer |
| (Cgn) | Cytidine-glycol nucleic acid (GNA) S-Isomer |
| (Ggn) | Guanosine-glycol nucleic acid (GNA) S-Isomer |
| (Tgn) | Thymidine-glycol nucleic acid (GNA) S-Isomer |
| P | Phosphate |
| VP | Vinyl-phosphonate |
| dA | 2'-deoxyadenosine-3'-phosphate |
| dAs | 2'-deoxyadenosine-3'-phosphorothioate |
| dC | 2'-deoxycytidine-3'-phosphate |
| dCs | 2'-deoxycytidine-3'-phosphorothioate |
| dG | 2'-deoxyguanosine-3'-phosphate |
| dGs | 2'-deoxyguanosine-3'-phosphorothioate |
| dT | 2'-deoxythymidine-3'-phosphate |
| dTs | 2'-deoxythymidine-3'-phosphorothioate |
| dU | 2'-deoxyuridine |
| dUs | 2'-deoxyuridine-3'-phosphorothioate |
| (C2p) | cytidine-2'-phosphate |
| (G2p) | guanosine-2'-phosphate |
| (U2p) | uridine-2'-phosphate |
| (A2p) | adenosine-2'-phosphate |
| (Ahd) | 2'-O-hexadecyl-adenosine-3'-phosphate |
| (Ahds) | 2'-O-hexadecyl-adenosine-3'-phosphorothioate |
| (Chd) | 2'-O-hexadecyl-cytidine-3'-phosphate |
| (Chds) | 2'-O-hexadecyl-cytidine-3'-phosphorothioate |
| (Ghd) | 2'-O-hexadecyl-guanosine-3'-phosphate |
| (Ghds) | 2'-O-hexadecyl-guanosine-3'-phosphorothioate |
| (Uhd) | 2'-O-hexadecyl-uridine-3'-phosphate |
| (Uhds) | 2'-O-hexadecyl-uridine-3'-phosphorothioate |

TABLE 2

Unmodified Sense and Antisense Strand Sequences of Complement Factor B dsRNA Agents

| Duplex Name | Sense Strand Sequence 5' to 3' | SEQ ID NO: | Range in NM_001710.6 | Antisense Strand Sequence 5' to 3' | SEQ ID NO: | Range in NM_001710.6 |
| --- | --- | --- | --- | --- | --- | --- |
| AD-1724362 | AAGGGAAUGUGACCAGGUCUU | 19 | 4-24 | AAGACCUGGUCACAUUCCCUUCC | 412 | 2-24 |
| AD-1724363 | AGGGAAUGUGACCAGGUCUAU | 20 | 5-25 | AUAGACCUGGUCACAUUCCCUUC | 413 | 3-25 |
| AD-1724364 | GGGAAUGUGACCAGGUCUAGU | 21 | 6-26 | ACUAGACCUGGUCACAUUCCCUU | 414 | 4-26 |
| AD-1724365 | GGAAUGUGACCAGGUCUAGGU | 22 | 7-27 | ACCUAGACCUGGUCACAUUCCCU | 415 | 5-27 |
| AD-1724369 | UGUGACCAGGUCUAGGUCUGU | 23 | 11-31 | ACAGACCUAGACCUGGUCACAUU | 416 | 9-31 |
| AD-1724370 | GUGACCAGGUCUAGGUCUGGU | 24 | 12-32 | ACCAGACCUAGACCUGGUCACAU | 417 | 10-32 |
| AD-1724376 | AGGUCUAGGUCUGGAGUUUCU | 25 | 18-38 | AGAAACUCCAGACCUAGACCUGG | 418 | 16-38 |
| AD-1724384 | GUCUGGAGUUUCAGCUUGGAU | 26 | 26-46 | AUCCAAGCUGAAACUCCAGACCU | 419 | 24-46 |
| AD-1724385 | UCUGGAGUUUCAGCUUGGACU | 27 | 27-47 | AGUCCAAGCUGAAACUCCAGACC | 420 | 25-47 |

TABLE 2-continued

Unmodified Sense and Antisense Strand Sequences of Complement Factor B dsRNA Agents

| Duplex Name | Sense Strand Sequence 5' to 3' | SEQ ID NO: | Range in NM_001710.6 | Antisense Strand Sequence 5' to 3' | SEQ ID NO: | Range in NM_001710.6 |
|---|---|---|---|---|---|---|
| AD-1724386 | CUGGAGUUUCAGCUUGGACAU | 28 | 28-48 | ATGUCCAAGCUGAAACUCCAGAC | 421 | 26-48 |
| AD-1724530 | UCCUUCCGACUUCUCCAAGAU | 29 | 269-289 | ATCUTGGAGAAGUCGGAAGGAGC | 422 | 267-289 |
| AD-1724572 | UGUCCUUCUGGCUUCUACCCU | 30 | 311-331 | AGGGTAGAAGCCAGAAGGACACA | 423 | 309-331 |
| AD-1724574 | UCCUUCUGGCUUCUACCCGUU | 31 | 313-333 | AACGGGTAGAAGCCAGAAGGACA | 424 | 311-333 |
| AD-1724575 | CCUUCUGGCUUCUACCCGUAU | 32 | 314-334 | ATACGGGUAGAAGCCAGAAGGAC | 425 | 312-334 |
| AD-1724576 | CUUCUGGCUUCUACCCGUACU | 33 | 315-335 | AGUACGGGUAGAAGCCAGAAGGA | 426 | 313-335 |
| AD-1724579 | CUGGCUUCUACCCGUACCCUU | 34 | 318-338 | AAGGGUACGGGUAGAAGCCAGAA | 427 | 316-338 |
| AD-1724586 | CUACCCGUACCCUGUGCAGAU | 35 | 325-345 | ATCUGCACAGGGUACGGGUAGAA | 428 | 323-345 |
| AD-1724600 | UGCAGACACGUACCUGCAGAU | 36 | 339-359 | ATCUGCAGGUACGUGUCUGCACA | 429 | 337-359 |
| AD-1724651 | AAGGCAGAGUGCAGAGCAAUU | 37 | 410-430 | AAUUGCUCUGCACUCUGCCUUCC | 430 | 408-430 |
| AD-1724653 | GGCAGAGUGCAGAGCAAUCCU | 38 | 412-432 | AGGATUGCUCUGCACUCUGCCUU | 431 | 410-432 |
| AD-1724685 | CGGUCUCCCUACUACAAUGUU | 39 | 476-496 | AACATUGUAGUAGGGAGACCGGG | 432 | 474-496 |
| AD-1724691 | CCCUACUACAAUGUGAGUGAU | 40 | 482-502 | ATCACUCACAUTGUAGUAGGGAG | 433 | 480-502 |
| AD-1724692 | CCUACUACAAUGUGAGUGAUU | 41 | 483-503 | AAUCACTCACATUGUAGUAGGGA | 434 | 481-503 |
| AD-1724693 | CUACUACAAUGUGAGUGAUGU | 42 | 484-504 | ACAUCACUCACAUUGUAGUAGGG | 435 | 482-504 |
| AD-1724695 | ACUACAAUGUGAGUGAUGAGU | 43 | 486-506 | ACUCAUCACUCACAUUGUAGUAG | 436 | 484-506 |
| AD-1724698 | ACAAUGUGAGUGAUGAGAUCU | 44 | 489-509 | AGAUCUCAUCACUCACAUUGUAG | 437 | 487-509 |
| AD-1724699 | CAAUGUGAGUGAUGAGAUCUU | 45 | 490-510 | AAGATCTCAUCACUCACAUUGUA | 438 | 488-510 |
| AD-1724700 | AAUGUGAGUGAUGAGAUCUCU | 46 | 491-511 | AGAGAUCUCAUCACUCACAUUGU | 439 | 489-511 |
| AD-1724701 | AUGUGAGUGAUGAGAUCUCUU | 47 | 492-512 | AAGAGATCUCATCACUCACAUUG | 440 | 490-512 |
| AD-1724702 | UGUGAGUGAUGAGAUCUCUUU | 48 | 493-513 | AAAAGAUCUCAUCACUCACAUU | 441 | 491-513 |
| AD-1724703 | GUGAGUGAUGAGAUCUCUUUU | 49 | 494-514 | AAAAGAGAUCUCAUCACUCACAU | 442 | 492-514 |
| AD-1724704 | UGAGUGAUGAGAUCUCUUUCU | 50 | 495-515 | AGAAAGAGAUCTCAUCACUCACA | 443 | 493-515 |
| AD-1724705 | GAGUGAUGAGAUCUCUUUCCU | 51 | 496-516 | AGGAAAGAGAUCUCAUCACUCAC | 444 | 494-516 |
| AD-1724706 | AGUGAUGAGAUCUCUUUCCAU | 52 | 497-517 | ATGGAAAGAGATCUCAUCACUCA | 445 | 495-517 |
| AD-1724707 | GUGAUGAGAUCUCUUUCCACU | 53 | 498-518 | AGUGGAAAGAGAUCUCAUCACUC | 446 | 496-518 |
| AD-1724708 | UGAUGAGAUCUCUUUCCACUU | 54 | 499-519 | AAGUGGAAAGAGAUCUCAUCACU | 447 | 497-519 |
| AD-1724714 | GAUCUCUUUCCACUGCUAUGU | 55 | 505-525 | ACAUAGCAGUGGAAAGAGAUCUC | 448 | 503-525 |
| AD-1724715 | AUCUCUUUCCACUGCUAUGAU | 56 | 506-526 | ATCATAGCAGUGGAAAGAGAUCU | 449 | 504-526 |
| AD-1724716 | UCUCUUUCCACUGCUAUGACU | 57 | 507-527 | AGUCAUAGCAGTGGAAAGAGAUC | 450 | 505-527 |
| AD-1724717 | CUCUUUCCACUGCUAUGACGU | 58 | 508-528 | ACGUCAUAGCAGUGGAAAGAGAU | 451 | 506-528 |
| AD-1724718 | UCUUUCCACUGCUAUGACGGU | 59 | 509-529 | ACCGTCAUAGCAGUGGAAAGAGA | 452 | 507-529 |
| AD-1724725 | ACUGCUAUGACGGUUACACUU | 60 | 516-536 | AAGUGUAACCGUCAUAGCAGUGG | 453 | 514-536 |
| AD-1724726 | CUGCUAUGACGGUUACACUCU | 61 | 517-537 | AGAGTGTAACCGUCAUAGCAGUG | 454 | 515-537 |
| AD-1724730 | UAUGACGGUUACACUCUCCGU | 62 | 521-541 | ACGGAGAGUGUAACCGUCAUAGC | 455 | 519-541 |
| AD-1724731 | AUGACGGUUACACUCUCCGGU | 63 | 522-542 | ACCGGAGAGUGTAACCGUCAUAG | 456 | 520-542 |
| AD-1724741 | AUCGCACCUGCCAAGUGAAUU | 64 | 552-572 | AAUUCACUUGGCAGGUGCGAUUG | 457 | 550-572 |

TABLE 2-continued

Unmodified Sense and Antisense Strand Sequences of Complement Factor B dsRNA Agents

| Duplex Name | Sense Strand Sequence 5' to 3' | SEQ ID NO: | Range in NM_001710.6 | Antisense Strand Sequence 5' to 3' | SEQ ID NO: | Range in NM_001710.6 |
|---|---|---|---|---|---|---|
| AD-1724742 | UCGCACCUGCCAAGUGAAUGU | 65 | 553-573 | ACAUTCACUUGGCAGGUGCGAUU | 458 | 551-573 |
| AD-1724743 | CGCACCUGCCAAGUGAAUGGU | 66 | 554-574 | ACCATCACUUGGCAGGUGCGAU | 459 | 552-574 |
| AD-1724776 | CAGACAGCGAUCUGUGACAAU | 67 | 587-607 | ATUGTCACAGATCGCUGUCUGCC | 460 | 585-607 |
| AD-1724777 | AGACAGCGAUCUGUGACAACU | 68 | 588-608 | AGUUGTCACAGAUCGCUGUCUGC | 461 | 586-608 |
| AD-1724778 | GACAGCGAUCUGUGACAACGU | 69 | 589-609 | ACGUTGTCACAGAUCGCUGUCUG | 462 | 587-609 |
| AD-1724779 | ACAGCGAUCUGUGACAACGGU | 70 | 590-610 | ACCGTUGUCACAGAUCGCUGUCU | 463 | 588-610 |
| AD-1724780 | CAGCGAUCUGUGACAACGGAU | 71 | 591-611 | ATCCGUTGUCACAGAUCGCUGUC | 464 | 589-611 |
| AD-1724781 | AGCGAUCUGUGACAACGGAGU | 72 | 592-612 | ACUCCGUUGUCACAGAUCGCUGU | 465 | 590-612 |
| AD-1724792 | UGGCACAAGGAAGGUGGGCAU | 73 | 643-663 | ATGCCCACCUUCCUUGUGCCAAU | 466 | 641-663 |
| AD-1724819 | CCGCCUUGAAGACAGCGUCAU | 74 | 670-690 | ATGACGCUGCUUCAAGGCGGUA | 467 | 668-690 |
| AD-1724823 | CUUGAAGACAGCGUCACCUAU | 75 | 674-694 | ATAGGUGACGCUGUCUUCAAGGC | 468 | 672-694 |
| AD-1724824 | UUGAAGACAGCGUCACCUACU | 76 | 675-695 | AGUAGGUGACGCUGUCUUCAAGG | 469 | 673-695 |
| AD-1724825 | UGAAGACAGCGUCACCUACCU | 77 | 676-696 | AGGUAGGUGACGCUGUCUUCAAG | 470 | 674-696 |
| AD-1724860 | GUGUCAGGAAGGUGGCUCUUU | 78 | 739-759 | AAAGAGCCACCUUCCUGACACGU | 471 | 737-759 |
| AD-1724894 | CCUUCCUGCCAAGACUCCUUU | 79 | 773-793 | AAAGGAGUCUUGGCAGGAAGGCU | 472 | 771-793 |
| AD-1724897 | UCCUGCCAAGACUCCUUCAUU | 80 | 776-796 | AAUGAAGGAGUCUUGGCAGGAAG | 473 | 774-796 |
| AD-1724899 | CUGCCAAGACUCCUUCAUGUU | 81 | 778-798 | AACATGAAGGAGUCUUGGCAGGA | 474 | 776-798 |
| AD-1724900 | UGCCAAGACUCCUUCAUGUAU | 82 | 779-799 | ATACAUGAAGGAGUCUUGGCAGG | 475 | 777-799 |
| AD-1724903 | CAAGACUCCUUCAUGUACGAU | 83 | 782-802 | ATCGUACAUGAAGGAGUCUUGGC | 476 | 780-802 |
| AD-1724904 | AAGACUCCUUCAUGUACGACU | 84 | 783-803 | AGUCGUACAUGAAGGAGUCUUGG | 477 | 781-803 |
| AD-1724905 | AGACUCCUUCAUGUACGACAU | 85 | 784-804 | ATGUCGUACAUGAAGGAGUCUUG | 478 | 782-804 |
| AD-1724906 | GACUCCUUCAUGUACGACACU | 86 | 785-805 | AGUGUCGUACATGAAGGAGUCUU | 479 | 783-805 |
| AD-1724910 | CAAGAGGUGGCCGAAGCUUUU | 87 | 809-829 | AAAAGCUCGGCCACCUCUUGAG | 480 | 807-829 |
| AD-1724919 | GCCGAAGCUUUCCUGUCUUCU | 88 | 818-838 | AGAAGACAGGAAAGCUUCGGCCA | 481 | 816-838 |
| AD-1724945 | AGAGACCAUAGAAGGAGUCGU | 89 | 844-864 | ACGACUCCUUCUAUGGUCUCUGU | 482 | 842-864 |
| AD-1724946 | GAGACCAUAGAAGGAGUCGAU | 90 | 845-865 | ATCGACUCCUUCUAUGGUCUCUG | 483 | 843-865 |
| AD-1724947 | AGACCAUAGAAGGAGUCGAUU | 91 | 846-866 | AAUCGACUCCUUCUAUGGUCUCU | 484 | 844-866 |
| AD-1724948 | GACCAUAGAAGGAGUCGAUGU | 92 | 847-867 | ACAUCGACUCCUUCUAUGGUCUC | 485 | 845-867 |
| AD-1724949 | ACCAUAGAAGGAGUCGAUGCU | 93 | 848-868 | AGCAUCGACUCCUUCUAUGGUCU | 486 | 846-868 |
| AD-1725000 | CCUUCAGGCUCCAUGAACAUU | 94 | 920-940 | AAUGUUCAUGGAGCCUGAAGGGU | 487 | 918-940 |
| AD-1725003 | UCAGGCUCCAUGAACAUCUAU | 95 | 923-943 | ATAGAUGUUCAUGGAGCCUGAAG | 488 | 921-943 |
| AD-1725004 | CAGGCUCCAUGAACAUCUACU | 96 | 924-944 | AGUAGAUGUUCAUGGAGCCUGAA | 489 | 922-944 |
| AD-1725013 | UGAACAUCUACCUGGUGCUAU | 97 | 933-953 | ATAGCACCAGGUAGAUGUUCAUG | 490 | 931-953 |
| AD-1725015 | AACAUCUACCUGGUGCUAGAU | 98 | 935-955 | ATCUAGCACCAGGUAGAUGUUCA | 491 | 933-955 |
| AD-1725017 | CAUCUACCUGGUGCUAGAUGU | 99 | 937-957 | ACAUCUAGCACCAGGUAGAUGUU | 492 | 935-957 |
| AD-1725018 | AUCUACCUGGUGCUAGAUGGU | 100 | 938-958 | ACCATCUAGCACCAGGUAGAUGU | 493 | 936-958 |
| AD-1725019 | UCUACCUGGUGCUAGAUGGAU | 101 | 939-959 | ATCCAUCUAGCACCAGGUAGAUG | 494 | 937-959 |

TABLE 2-continued

Unmodified Sense and Antisense Strand Sequences of Complement Factor B dsRNA Agents

| Duplex Name | Sense Strand Sequence 5' to 3' | SEQ ID NO: | Range in NM_001710.6 | Antisense Strand Sequence 5' to 3' | SEQ ID NO: | Range in NM_001710.6 |
|---|---|---|---|---|---|---|
| AD-1725020 | CUACCUGGUGCUAGAUGGAUU | 102 | 940-960 | AAUCCAUCUAGCACCAGGUAGAU | 495 | 938-960 |
| AD-1725021 | UACCUGGUGCUAGAUGGAUCU | 103 | 941-961 | AGAUCCAUCUAGCACCAGGUAGA | 496 | 939-961 |
| AD-1725022 | ACCUGGUGCUAGAUGGAUCAU | 104 | 942-962 | ATGATCCAUCUAGCACCAGGUAG | 497 | 940-962 |
| AD-1725023 | CCUGGUGCUAGAUGGAUCAGU | 105 | 943-963 | ACUGAUCCAUCUAGCACCAGGUA | 498 | 941-963 |
| AD-1725025 | UGGUGCUAGAUGGAUCAGACU | 106 | 945-965 | AGUCUGAUCCAUCUAGCACCAGG | 499 | 943-965 |
| AD-1725027 | GUGCUAGAUGGAUCAGACAGU | 107 | 947-967 | ACUGUCUGAUCCAUCUAGCACCA | 500 | 945-967 |
| AD-1725028 | UGCUAGAUGGAUCAGACAGCU | 108 | 948-968 | AGCUGUCUGAUCCAUCUAGCACC | 501 | 946-968 |
| AD-1725033 | GAUGGAUCAGACAGCAUUGGU | 109 | 953-973 | ACCAAUGCUGUCUGAUCCAUCUA | 502 | 951-973 |
| AD-1725039 | CAACUUCACAGGAGCCAAAAU | 110 | 979-999 | AUUUUGGCUCCUGUGAAGUUGCU | 503 | 977-999 |
| AD-1725040 | AACUUCACAGGAGCCAAAAAU | 111 | 980-1000 | AUUUUGGCUCCUGUGAAGUUGC | 504 | 978-1000 |
| AD-1725041 | ACUUCACAGGAGCCAAAAAGU | 112 | 981-1001 | ACUUUUGGCUCCUGUGAAGUUG | 505 | 979-1001 |
| AD-1725042 | CUUCACAGGAGCCAAAAAGUU | 113 | 982-1002 | AACUUUUGGCUCCUGUGAAGUU | 506 | 980-1002 |
| AD-1725043 | UUCACAGGAGCCAAAAAGUGU | 114 | 983-1003 | ACACUUUUGGCUCCUGUGAAGU | 507 | 981-1003 |
| AD-1725044 | UCACAGGAGCCAAAAAGUGUU | 115 | 984-1004 | AACACUUUUGGCUCCUGUGAAG | 508 | 982-1004 |
| AD-1725045 | CACAGGAGCCAAAAAGUGUCU | 116 | 985-1005 | AGACACUUUUGGCUCCUGUGAA | 509 | 983-1005 |
| AD-1725046 | ACAGGAGCCAAAAAGUGUCUU | 117 | 986-1006 | AAGACACUUUUGGCUCCUGUGA | 510 | 984-1006 |
| AD-1725047 | CAGGAGCCAAAAAGUGUCUAU | 118 | 987-1007 | AUAGACACUUUUGGCUCCUGUG | 511 | 985-1007 |
| AD-1725048 | AGGAGCCAAAAAGUGUCUAGU | 119 | 988-1008 | ACUAGACACUUUUGGCUCCUGU | 512 | 986-1008 |
| AD-1725049 | GGAGCCAAAAAGUGUCUAGUU | 120 | 989-1009 | AACUAGACACUUUUGGCUCCUG | 513 | 987-1009 |
| AD-1725050 | GAGCCAAAAAGUGUCUAGUCU | 121 | 990-1010 | AGACUAGACACUUUUGGCUCCU | 514 | 988-1010 |
| AD-1725051 | AGCCAAAAAGUGUCUAGUCAU | 122 | 991-1011 | AUGACUAGACACUUUUUGGCUCC | 515 | 989-1011 |
| AD-1725052 | GCCAAAAAGUGUCUAGUCAAU | 123 | 992-1012 | AUUGACUAGACACUUUUGGCUC | 516 | 990-1012 |
| AD-1725053 | CCAAAAAGUGUCUAGUCAACU | 124 | 993-1013 | AGUUGACUAGACACUUUUGGCU | 517 | 991-1013 |
| AD-1725054 | CAAAAAGUGUCUAGUCAACUU | 125 | 994-1014 | AAGUUGACUAGACACUUUUGGC | 518 | 992-1014 |
| AD-1725055 | AAAAAGUGUCUAGUCAACUUU | 126 | 995-1015 | AAAGUUGACUAGACACUUUUGG | 519 | 993-1015 |
| AD-1725056 | AAAAGUGUCUAGUCAACUUAU | 127 | 996-1016 | AUAAGUUGACUAGACACUUUUG | 520 | 994-1016 |
| AD-1725057 | AAAGUGUCUAGUCAACUUAAU | 128 | 997-1017 | AUUAAGUUGACUAGACACUUUU | 521 | 995-1017 |
| AD-1725058 | AAGUGUCUAGUCAACUUAAUU | 129 | 998-1018 | AAUUAAGUUGACUAGACACUUU | 522 | 996-1018 |
| AD-1725059 | AGUGUCUAGUCAACUUAAUUU | 130 | 999-1019 | AAAUUAAGUUGACUAGACACUU | 523 | 997-1019 |
| AD-1725060 | GUGUCUAGUCAACUUAAUUGU | 131 | 1000-1020 | ACAAUUAAGUUGACUAGACACUU | 524 | 998-1020 |
| AD-1725061 | UGUCUAGUCAACUUAAUUGAU | 132 | 1001-1021 | AUCAAUUAAGUUGACUAGACACU | 525 | 999-1021 |
| AD-1725062 | GUCUAGUCAACUUAAUUGAGU | 133 | 1002-1022 | ACUCAAUUAAGUUGACUAGACAC | 526 | 1000-1022 |
| AD-1725066 | AGUCAACUUAAUUGAGAAGGU | 134 | 1006-1026 | ACCUUCUCAAUUAAGUUGACUAG | 527 | 1004-1026 |
| AD-1725074 | UAAUUGAGAAGGUGGCAAGUU | 135 | 1014-1034 | AACUUGCCACCUUCUCAAUUAAG | 528 | 1012-1034 |
| AD-1725075 | AAUUGAGAAGGUGGCAAGUUU | 136 | 1015-1035 | AAACUUGCCACCUUCUCAAUUAA | 529 | 1013-1035 |
| AD-1725079 | GAGAAGGUGGCAAGUUAUGGU | 137 | 1019-1039 | ACCAUAACUUGCCACCUUCUCAA | 530 | 1017-1039 |
| AD-1725080 | AGAAGGUGGCAAGUUAUGGUU | 138 | 1020-1040 | AACCAUAACUUGCCACCUUCUCA | 531 | 1018-1040 |

TABLE 2-continued

Unmodified Sense and Antisense Strand Sequences of Complement Factor B dsRNA Agents

| Duplex Name | Sense Strand Sequence 5' to 3' | SEQ ID NO: | Range in NM_001710.6 | Antisense Strand Sequence 5' to 3' | SEQ ID NO: | Range in NM_001710.6 |
|---|---|---|---|---|---|---|
| AD-1725082 | AAGGUGGCAAGUUAUGGUGUU | 139 | 1022-1042 | AACACCAUAACUUGCCACCUUCU | 532 | 1020-1042 |
| AD-1725083 | AGGUGGCAAGUUAUGGUGUGU | 140 | 1023-1043 | ACACACCAUAACUUGCCACCUUC | 533 | 1021-1043 |
| AD-1725088 | GCAAGUUAUGGUGUGAAGCCU | 141 | 1028-1048 | AGGCUCACACCAUAACUUGCCA | 534 | 1026-1048 |
| AD-1725092 | GUUAUGGUGUGAAGCCAAGAU | 142 | 1032-1052 | ATCUTGGCUUCACACCAUAACUU | 535 | 1030-1052 |
| AD-1725095 | AUGGUGUGAAGCCAAGAUAUU | 143 | 1035-1055 | AAUAUCUUGGCUUCACACCAUAA | 536 | 1033-1055 |
| AD-1725096 | UGGUGUGAAGCCAAGAUAUGU | 144 | 1036-1056 | ACAUAUCUUGGCUUCACACCAUA | 537 | 1034-1056 |
| AD-1725122 | AAAAUUUGGGUCAAAGUGUCU | 145 | 1082-1102 | AGACACUUUGACCCAAAUUUUGG | 538 | 1080-1102 |
| AD-1725123 | AAAUUUGGGUCAAAGUGUCUU | 146 | 1083-1103 | AAGACACUUUGACCCAAAUUUUG | 539 | 1081-1103 |
| AD-1725125 | AUUUGGGUCAAAGUGUCUGAU | 147 | 1085-1105 | ATCAGACACUUGACCCAAAUUU | 540 | 1083-1105 |
| AD-1725156 | GUAAUGCAGACUGGGUCACGU | 148 | 1116-1136 | ACGUGACCCAGUCUGCAUUACUG | 541 | 1114-1136 |
| AD-1725157 | UAAUGCAGACUGGGUCACGAU | 149 | 1117-1137 | ATCGUGACCCAGUCUGCAUUACU | 542 | 1115-1137 |
| AD-1725158 | AAUGCAGACUGGGUCACGAAU | 150 | 1118-1138 | ATUCGUGACCCAGUCUGCAUUAC | 543 | 1116-1138 |
| AD-1725159 | AUGCAGACUGGGUCACGAAGU | 151 | 1119-1139 | ACUUCGUGACCCAGUCUGCAUUA | 544 | 1117-1139 |
| AD-1725184 | AAUGAAAUCAAUUAUGAAGAU | 152 | 1145-1165 | ATCUTCAUAAUTGAUUUCAUUGA | 545 | 1143-1165 |
| AD-1725186 | UGAAAUCAAUUAUGAAGACCU | 153 | 1147-1167 | AGGUCUTCAUAAUUGAUUUCAUU | 546 | 1145-1167 |
| AD-1725189 | AAUCAAUUAUGAAGACCACAU | 154 | 1150-1170 | ATGUGGUCUUCAUAAUUGAUUUC | 547 | 1148-1170 |
| AD-1725190 | AUCAAUUAUGAAGACCACAAU | 155 | 1151-1171 | ATUGUGGUCUUCAUAAUUGAUUU | 548 | 1149-1171 |
| AD-1725191 | UCAAUUAUGAAGACCACAAGU | 156 | 1152-1172 | ACUUGUGGUCUTCAUAAUUGAUU | 549 | 1150-1172 |
| AD-1725192 | CAAUUAUGAAGACCACAAGUU | 157 | 1153-1173 | AACUTGUGGUCUUCAUAAUUGAU | 550 | 1151-1173 |
| AD-1725193 | AAUUAUGAAGACCACAAGUUU | 158 | 1154-1174 | AAACUTGUGGUCUUCAUAAUUGA | 551 | 1152-1174 |
| AD-1725194 | AUUAUGAAGACCACAAGUUGU | 159 | 1155-1175 | ACAACUTGUGGUCUUCAUAAUUG | 552 | 1153-1175 |
| AD-1725195 | UUAUGAAGACCACAAGUUGAU | 160 | 1156-1176 | ATCAACUTGUGGUCUUCAUAAUU | 553 | 1154-1176 |
| AD-1725196 | UAUGAAGACCACAAGUUGAAU | 161 | 1157-1177 | ATUCAACUTGUGGUCUUCAUAAU | 554 | 1155-1177 |
| AD-1725197 | AUGAAGACCACAAGUUGAAGU | 162 | 1158-1178 | ACUUCAACUUGUGGUCUUCAUAA | 555 | 1156-1178 |
| AD-1725198 | UGAAGACCACAAGUUGAAGUU | 163 | 1159-1179 | AACUTCAACUUGUGGUCUUCAUA | 556 | 1157-1179 |
| AD-1725199 | GAAGACCACAAGUUGAAGUCU | 164 | 1160-1180 | AGACUUCAACUTGUGGUCUUCAU | 557 | 1158-1180 |
| AD-1725200 | AAGACCACAAGUUGAAGUCAU | 165 | 1161-1181 | ATGACUTCAACUUGUGGUCUUCA | 558 | 1159-1181 |
| AD-1725201 | AGACCACAAGUUGAAGUCAGU | 166 | 1162-1182 | ACUGACUTCAACUUGUGGUCUUC | 559 | 1160-1182 |
| AD-1725203 | ACCACAAGUUGAAGUCAGGGU | 167 | 1164-1184 | ACCCUGACUTCAACUTGUGGUCU | 560 | 1162-1184 |
| AD-1725204 | CCACAAGUUGAAGUCAGGGAU | 168 | 1165-1185 | ATCCCUGACUUCAACUTGUGGUC | 561 | 1163-1185 |
| AD-1725205 | CACAAGUUGAAGUCAGGGACU | 169 | 1166-1186 | AGUCCCUGACUTCAACUTGUGGU | 562 | 1164-1186 |
| AD-1725206 | ACAAGUUGAAGUCAGGGACUU | 170 | 1167-1187 | AAGUCCCUGACUUCAACUUGUGG | 563 | 1165-1187 |
| AD-1725208 | AAGUUGAAGUCAGGGACUAAU | 171 | 1169-1189 | ATUAGUCCCUGACUUCAACUUGU | 564 | 1167-1189 |
| AD-1725211 | UUGAAGUCAGGGACUAACACU | 172 | 1172-1192 | AGUGUAGUCCCUGACUUCAACU | 565 | 1170-1192 |
| AD-1725212 | UGAAGUCAGGGACUAACACCU | 173 | 1173-1193 | AGGUGUAGUCCCUGACUUCAAC | 566 | 1171-1193 |
| AD-1725215 | AGUCAGGGACUAACACCAAGU | 174 | 1176-1196 | ACUUGGUGUUAGUCCCUGACUUC | 567 | 1174-1196 |
| AD-1725216 | GUCAGGGACUAACACCAAGAU | 175 | 1177-1197 | ATCUTGGUGUUAGUCCCUGACUU | 568 | 1175-1197 |

TABLE 2-continued

Unmodified Sense and Antisense Strand Sequences of Complement Factor B dsRNA Agents

| Duplex Name | Sense Strand Sequence 5' to 3' | SEQ ID NO: | Range in NM_001710.6 | Antisense Strand Sequence 5' to 3' | SEQ ID NO: | Range in NM_001710.6 |
| --- | --- | --- | --- | --- | --- | --- |
| AD-1725243 | CCAGGCAGUGUACAGCAUGAU | 176 | 1204-1224 | ATCATGCUGUACACUGCCUGGAG | 569 | 1202-1224 |
| AD-1725244 | CAGGCAGUGUACAGCAUGAUU | 177 | 1205-1225 | AAUCAUGCUGUACACUGCCUGGA | 570 | 1203-1225 |
| AD-1725245 | AGGCAGUGUACAGCAUGAUGU | 178 | 1206-1226 | ACAUCATGCUGUACACUGCCUGG | 571 | 1204-1226 |
| AD-1725247 | GCAGUGUACAGCAUGAUGAGU | 179 | 1208-1228 | ACUCAUCAUGCUGUACACUGCCU | 572 | 1206-1228 |
| AD-1725327 | CUGAUGGAUUGCACAACAUGU | 180 | 1290-1310 | ACAUGUUGUGCAAUCCAUCAGUC | 573 | 1288-1310 |
| AD-1725328 | UGAUGGAUUGCACAACAUGGU | 181 | 1291-1311 | ACCAUGUUGUGCAAUCCAUCAGU | 574 | 1289-1311 |
| AD-1725329 | GAUGGAUUGCACAACAUGGGU | 182 | 1292-1312 | ACCCAUGUUGUGCAAUCCAUCAG | 575 | 1290-1312 |
| AD-1725330 | AUGGAUUGCACAACAUGGGCU | 183 | 1293-1313 | AGCCCAUGUUGUGCAAUCCAUCA | 576 | 1291-1313 |
| AD-1725331 | UGGAUUGCACAACAUGGGCGU | 184 | 1294-1314 | ACGCCCAUGUUGUGCAAUCCAUC | 577 | 1292-1314 |
| AD-1725332 | GGAUUGCACAACAUGGGCGGU | 185 | 1295-1315 | ACCGCCCAUGUUGUGCAAUCCAU | 578 | 1293-1315 |
| AD-1725333 | GACCCAAUUACUGUCAUUGAU | 186 | 1316-1336 | ATCAAUGACAGUAAUUGGGUCCC | 579 | 1314-1336 |
| AD-1725334 | ACCCAAUUACUGUCAUUGAUU | 187 | 1317-1337 | AAUCAAUGACAGUAAUUGGGUCC | 580 | 1315-1337 |
| AD-1725336 | CCAAUUACUGUCAUUGAUGAU | 188 | 1319-1339 | ATCAUCAAUGACAGUAAUUGGGU | 581 | 1317-1339 |
| AD-1725344 | UGUCAUUGAUGAGAUCCGGGU | 189 | 1327-1347 | ACCCGGAUCUCAUCAAUGACAGU | 582 | 1325-1347 |
| AD-1725345 | GUCAUUGAUGAGAUCCGGGAU | 190 | 1328-1348 | AUCCCGGAUCUCAUCAAUGACAG | 583 | 1326-1348 |
| AD-1725347 | CAUUGAUGAGAUCCGGGACUU | 191 | 1330-1350 | AAGUCCCGGAUCUCAUCAAUGAC | 584 | 1328-1350 |
| AD-1725348 | AUUGAUGAGAUCCGGGACUUU | 192 | 1331-1351 | AAAGUCCCGGAUCUCAUCAAUGA | 585 | 1329-1351 |
| AD-1725376 | UUGGCAAGGAUCGCAAAAACU | 193 | 1359-1379 | AGUUUUGCGAUCCUUGCCAAUG | 586 | 1357-1379 |
| AD-1725377 | UGGCAAGGAUCGCAAAAACCU | 194 | 1360-1380 | AGGUUUUGCGAUCCUUGCCAAU | 587 | 1358-1380 |
| AD-1725378 | GGCAAGGAUCGCAAAAACCCU | 195 | 1361-1381 | AGGGUUUUGCGAUCCUUGCCAA | 588 | 1359-1381 |
| AD-1725397 | CAAGGGAGGAUUAUCUGGAUU | 196 | 1380-1400 | AAUCCAGAUAAUCCUCCCUUGGG | 589 | 1378-1400 |
| AD-1725402 | GAGGAUUAUCUGGAUGUCUAU | 197 | 1385-1405 | AUAGACAUCCAGAUAAUCCUCCC | 590 | 1383-1405 |
| AD-1725403 | AGGAUUAUCUGGAUGUCUAUU | 198 | 1386-1406 | AAUAGACAUCCAGAUAAUCCUCC | 591 | 1384-1406 |
| AD-1725404 | GGAUUAUCUGGAUGUCUAUGU | 199 | 1387-1407 | ACAUAGACAUCCAGAUAAUCCUC | 592 | 1385-1407 |
| AD-1725405 | GAUUAUCUGGAUGUCUAUGUU | 200 | 1388-1408 | AACAUAGACAUCCAGAUAAUCCU | 593 | 1386-1408 |
| AD-1725406 | AUUAUCUGGAUGUCUAUGUGU | 201 | 1389-1409 | ACACAUAGACAUCCAGAUAAUCC | 594 | 1387-1409 |
| AD-1725407 | UUAUCUGGAUGUCUAUGUGUU | 202 | 1390-1410 | AACACAUAGACAUCCAGAUAAUC | 595 | 1388-1410 |
| AD-1725408 | UAUCUGGAUGUCUAUGUGUUU | 203 | 1391-1411 | AAACACAUAGACAUCCAGAUAAU | 596 | 1389-1411 |
| AD-1725409 | AUCUGGAUGUCUAUGUGUUUU | 204 | 1392-1412 | AAAACACAUAGACAUCCAGAUAA | 597 | 1390-1412 |
| AD-1725410 | UCUGGAUGUCUAUGUGUUUGU | 205 | 1393-1413 | ACAAACACAUAGACAUCCAGAUA | 598 | 1391-1413 |
| AD-1725411 | CUGGAUGUCUAUGUGUUUGGU | 206 | 1394-1414 | ACCAAACACAUAGACAUCCAGAU | 599 | 1392-1414 |
| AD-1725427 | AACCAAGUGAACAUCAAUGCU | 207 | 1430-1450 | AGCAUUGAUGUUCACUUGGUUCA | 600 | 1428-1450 |
| AD-1725428 | ACCAAGUGAACAUCAAUGCUU | 208 | 1431-1451 | AAGCAUUGAUGUUCACUUGGUUC | 601 | 1429-1451 |
| AD-1725429 | CCAAGUGAACAUCAAUGCUUU | 209 | 1432-1452 | AAAGCAUUGAUGUUCACUUGGUU | 602 | 1430-1452 |
| AD-1725430 | CAAGUGAACAUCAAUGCUUUU | 210 | 1433-1453 | AAAAGCAUUGAUGUUCACUUGGU | 603 | 1431-1453 |
| AD-1725439 | AUCAAUGCUUUGGCUUCCAAU | 211 | 1442-1462 | AUUGGAAGCCAAAGCAUUGAUGU | 604 | 1440-1462 |
| AD-1725440 | UCAAUGCUUUGGCUUCCAAGU | 212 | 1443-1463 | ACUUGGAAGCCAAAGCAUUGAUG | 605 | 1441-1463 |

TABLE 2-continued

Unmodified Sense and Antisense Strand Sequences of Complement Factor B dsRNA Agents

| Duplex Name | Sense Strand Sequence 5' to 3' | SEQ ID NO: | Range in NM_001710.6 | Antisense Strand Sequence 5' to 3' | SEQ ID NO: | Range in NM_001710.6 |
|---|---|---|---|---|---|---|
| AD-1725441 | CAAUGCUUUGGCUUCCAAGAU | 213 | 1444-1464 | ATCUTGGAAGCCAAAGCAUUGAU | 606 | 1442-1464 |
| AD-1725449 | UGGCUUCCAAGAAAGACAAUU | 214 | 1452-1472 | AAUUGUCUUUCUGGAAGCCAAA | 607 | 1450-1472 |
| AD-1725453 | UUCCAAGAAAGACAAUGAGCU | 215 | 1456-1476 | AGCUCATUGUCUUUCUUGGAAGC | 608 | 1454-1476 |
| AD-1725454 | UCCAAGAAAGACAAUGAGCAU | 216 | 1457-1477 | ATGCUCAUUGUCUUUCUUGGAAG | 609 | 1455-1477 |
| AD-1725456 | CAAGAAAGACAAUGAGCAACU | 217 | 1459-1479 | AGUUGCUCAUUGUCUUUCUUGGA | 610 | 1457-1479 |
| AD-1725457 | AAGAAAGACAAUGAGCAACAU | 218 | 1460-1480 | ATGUUGCUCAUTGUCUUUCUUGG | 611 | 1458-1480 |
| AD-1725460 | AAAGACAAUGAGCAACAUGUU | 219 | 1463-1483 | AACATGTUGCUCAUUGUCUUUCU | 612 | 1461-1483 |
| AD-1725462 | AGACAAUGAGCAACAUGUGUU | 220 | 1465-1485 | AACACATGUUGCUCAUUGUCUUU | 613 | 1463-1485 |
| AD-1725463 | GACAAUGAGCAACAUGUGUUU | 221 | 1466-1486 | AAACACAUGUUGCUCAUUGUCUU | 614 | 1464-1486 |
| AD-1725464 | ACAAUGAGCAACAUGUGUUCU | 222 | 1467-1487 | AGAACACAUGUGCUCAUUGUCU | 615 | 1465-1487 |
| AD-1725465 | CAAUGAGCAACAUGUGUUCAU | 223 | 1468-1488 | ATGAACACAUGUUGCUCAUUGUC | 616 | 1466-1488 |
| AD-1725467 | AUGAGCAACAUGUGUUCAAAU | 224 | 1470-1490 | AUUGAACACATGUUGCUCAUUG | 617 | 1468-1490 |
| AD-1725469 | GAGCAACAUGUGUUCAAAGUU | 225 | 1472-1492 | AACUUGAACACAUGUUGCUCAU | 618 | 1470-1492 |
| AD-1725470 | AGCAACAUGUGUUCAAAGUCU | 226 | 1473-1493 | AGACUTUGAACACAUGUUGCUCA | 619 | 1471-1493 |
| AD-1725472 | CAACAUGUGUUCAAAGUCAUU | 227 | 1475-1495 | ATUGACUUGAACACAUGUUGCU | 620 | 1473-1495 |
| AD-1725473 | AACAUGUGUUCAAAGUCAAGU | 228 | 1476-1496 | ACUUGACUUUGAACACAUGUUGC | 621 | 1474-1496 |
| AD-1725474 | ACAUGUGUUCAAAGUCAAGGU | 229 | 1477-1497 | ACCUTGACUUUGAACACAUGUUG | 622 | 1475-1497 |
| AD-1725476 | AUGUGUUCAAAGUCAAGGAUU | 230 | 1479-1499 | AAUCCUGACUTUGAACACAUGU | 623 | 1477-1499 |
| AD-1725477 | UGUGUUCAAAGUCAAGGAUAU | 231 | 1480-1500 | ATAUCCUGACUUGAACACAUG | 624 | 1478-1500 |
| AD-1725478 | GUGUUCAAAGUCAAGGAUAUU | 232 | 1481-1501 | AAUAUCCUUGACUUUGAACACAU | 625 | 1479-1501 |
| AD-1725481 | UUCAAAGUCAAGGAUAUGGAU | 233 | 1484-1504 | ATCCAUAUCCUGACUUUGAACA | 626 | 1482-1504 |
| AD-1725482 | UCAAAGUCAAGGAUAUGGAAU | 234 | 1485-1505 | ATUCCATAUCCUGACUUUGAAC | 627 | 1483-1505 |
| AD-1725483 | CAAAGUCAAGGAUAUGGAAAU | 235 | 1486-1506 | ATUCCAUAUCCUUGACUUUGAA | 628 | 1484-1506 |
| AD-1725534 | UGAAAGCCAGUCUCUGAGUCU | 236 | 1537-1557 | AGACTCAGAGACUGGCUUUCAUC | 629 | 1535-1557 |
| AD-1725535 | GAAAGCCAGUCUCUGAGUCUU | 237 | 1538-1558 | AAGACUCAGAGACUGGCUUUCAU | 630 | 1536-1558 |
| AD-1725548 | UGAGUCUCUGUGGCAUGGUUU | 238 | 1551-1571 | AAACCATGCCACAGAGACUCAGA | 631 | 1549-1571 |
| AD-1725552 | UCUCUGUGGCAUGGUUUGGGU | 239 | 1555-1575 | ACCCAAACCAUGCCACAGAGACU | 632 | 1553-1575 |
| AD-1725556 | UGUGGCAUGGUUUGGGAACAU | 240 | 1559-1579 | ATGUUCCCAAACCAUGCCACAGA | 633 | 1557-1579 |
| AD-1725558 | UGGCAUGGUUUGGGAACACAU | 241 | 1561-1581 | ATGUGUCCCAAACCAUGCCACA | 634 | 1559-1581 |
| AD-1725580 | AAGGGUACCGAUUACCACAAU | 242 | 1583-1603 | ATUGTGGUAAUCGGUACCCUUCC | 635 | 1581-1603 |
| AD-1725582 | GGGUACCGAUUACCACAAGCU | 243 | 1585-1605 | AGCUTGTGGUAAUCGGUACCCUU | 636 | 1583-1605 |
| AD-1725585 | UACCGAUUACCACAAGCAACU | 244 | 1588-1608 | AGUUGCUGUGGUAAUCGGUACC | 637 | 1586-1608 |
| AD-1725587 | CCGAUUACCACAAGCAACCAU | 245 | 1590-1610 | ATGGUUGCUUGTGGUAAUCGGUA | 638 | 1588-1610 |
| AD-1725588 | CGAUUACCACAAGCAACCAUU | 246 | 1591-1611 | AAUGGUTGCUUGUGGUAAUCGGU | 639 | 1589-1611 |
| AD-1725590 | AUUACCACAAGCAACCAUGGU | 247 | 1593-1613 | ACCATGGUUGCUUGUGGUAAUCG | 640 | 1591-1613 |
| AD-1725591 | UUACCACAAGCAACCAUGGCU | 248 | 1594-1614 | AGCCAUGGUUGCUUGUGGUAAUC | 641 | 1592-1614 |
| AD-1725592 | UACCACAAGCAACCAUGGCAU | 249 | 1595-1615 | ATGCCATGGUUGCUUGUGGUAAU | 642 | 1593-1615 |

TABLE 2-continued

Unmodified Sense and Antisense Strand Sequences of Complement Factor B dsRNA Agents

| Duplex Name | Sense Strand Sequence 5' to 3' | SEQ ID NO: | Range in NM_001710.6 | Antisense Strand Sequence 5' to 3' | SEQ ID NO: | Range in NM_001710.6 |
|---|---|---|---|---|---|---|
| AD-1725593 | ACCACAAGCAACCAUGGCAGU | 250 | 1596-1616 | ACUGCCAUGGUUGCUUGUGGUAA | 643 | 1594-1616 |
| AD-1725598 | AAGCAACCAUGGCAGGCCAAU | 251 | 1601-1621 | ATUGGCCUGCCAUGGUUGCUUGU | 644 | 1599-1621 |
| AD-1725603 | ACCAUGGCAGGCCAAGAUCUU | 252 | 1606-1626 | AAGATCUGGCCUGCCAUGGUUG | 645 | 1604-1626 |
| AD-1725604 | CCAUGGCAGGCCAAGAUCUCU | 253 | 1607-1627 | AGAGAUCUUGGCCUGCCAUGGUU | 646 | 1605-1627 |
| AD-1725605 | CAUGGCAGGCCAAGAUCUCAU | 254 | 1608-1628 | ATGAGAUCUUGGCCUGCCAUGGU | 647 | 1606-1628 |
| AD-1725643 | GCUGUGGUGUCUGAGUACUUU | 255 | 1667-1687 | AAAGTACUCAGACACCACAGCCC | 648 | 1665-1687 |
| AD-1725644 | CUGUGGUGUCUGAGUACUUUU | 256 | 1668-1688 | AAAAGUACUCAGACACCACAGCC | 649 | 1666-1688 |
| AD-1725645 | UGUGGUGUCUGAGUACUUUGU | 257 | 1669-1689 | ACAAAGUACUCAGACACCACAGC | 650 | 1667-1689 |
| AD-1725646 | GUGGUGUCUGAGUACUUUGUU | 258 | 1670-1690 | AACAAAGUACUCAGACACCACAG | 651 | 1668-1690 |
| AD-1725647 | UGGUGUCUGAGUACUUUGUGU | 259 | 1671-1691 | ACACAAAGUACTCAGACACCACA | 652 | 1669-1691 |
| AD-1725667 | CUGACAGCAGCACAUUGUUUU | 260 | 1691-1711 | AAAACAAUGUGCUGCUGUCAGCA | 653 | 1689-1711 |
| AD-1725716 | AAGCGGGACCUGGAGAUAGAU | 261 | 1760-1780 | ATCUAUCUCCAGGUCCCGCUUCU | 654 | 1758-1780 |
| AD-1725717 | AGCGGGACCUGGAGAUAGAAU | 262 | 1761-1781 | ATUCTATCUCCAGGUCCCGCUUC | 655 | 1759-1781 |
| AD-1725756 | GAAGCAGGAAUUCCUGAAUUU | 263 | 1823-1843 | AAAUTCAGGAAUCCUGCUUCUU | 656 | 1821-1843 |
| AD-1725757 | AAGCAGGAAUUCCUGAAUUUU | 264 | 1824-1844 | AAAAUCAGGAAUUCCUGCUUCU | 657 | 1822-1844 |
| AD-1725759 | GCAGGAAUUCCUGAAUUUUAU | 265 | 1826-1846 | ATAAAAUCAGGAAUUCCUGCUU | 658 | 1824-1846 |
| AD-1725760 | CAGGAAUUCCUGAAUUUUAUU | 266 | 1827-1847 | AAUAAAAUUCAGGAAUUCCUGCU | 659 | 1825-1847 |
| AD-1725761 | AGGAAUUCCUGAAUUUUAUGU | 267 | 1828-1848 | ACAUAAAAUUCAGGAAUUCCUGC | 660 | 1826-1848 |
| AD-1725762 | GGAAUUCCUGAAUUUUAUGAU | 268 | 1829-1849 | ATCATAAAAUUCAGGAAUUCCUG | 661 | 1827-1849 |
| AD-1725763 | GAAUUCCUGAAUUUUAUGACU | 269 | 1830-1850 | AGUCAUAAAAUCAGGAAUUCCU | 662 | 1828-1850 |
| AD-1725764 | AAUUCCUGAAUUUUAUGACUU | 270 | 1831-1851 | AAGUCAUAAAAUCAGGAAUUCC | 663 | 1829-1851 |
| AD-1725765 | AUUCCUGAAUUUUAUGACUAU | 271 | 1832-1852 | ATAGTCAUAAAAUUCAGGAAUUC | 664 | 1830-1852 |
| AD-1725766 | UUCCUGAAUUUUAUGACUAUU | 272 | 1833-1853 | AAUAGUCAUAAAAUUCAGGAAUU | 665 | 1831-1853 |
| AD-1725767 | UCCUGAAUUUUAUGACUAUGU | 273 | 1834-1854 | ACAUAGTCAUAAAAUUCAGGAAU | 666 | 1832-1854 |
| AD-1725768 | CCUGAAUUUUAUGACUAUGAU | 274 | 1835-1855 | ATCATAGUCAUAAAAUUCAGGAA | 667 | 1833-1855 |
| AD-1725769 | CUGAAUUUUAUGACUAUGACU | 275 | 1836-1856 | AGUCAUAGUCAUAAAAUUCAGGA | 668 | 1834-1856 |
| AD-1725771 | GAAUUUUAUGACUAUGACGUU | 276 | 1838-1858 | AACGTCAUAGUCAUAAAAUUCAG | 669 | 1836-1858 |
| AD-1725772 | AAUUUUAUGACUAUGACGUUU | 277 | 1839-1859 | AAACGUCAUAGTCAUAAAAUUCA | 670 | 1837-1859 |
| AD-1725773 | AUUUUAUGACUAUGACGUUGU | 278 | 1840-1860 | ACAACGTCAUAGUCAUAAAAUUC | 671 | 1838-1860 |
| AD-1725775 | UUUAUGACUAUGACGUUGCCU | 279 | 1842-1862 | AGGCAACGUCAUAGUCAUAAAAU | 672 | 1840-1862 |
| AD-1725776 | UUAUGACUAUGACGUUGCCCU | 280 | 1843-1863 | AGGGCAACGUCAUAGUCAUAAAA | 673 | 1841-1863 |
| AD-1725777 | UAUGACUAUGACGUUGCCCUU | 281 | 1844-1864 | AAGGGCAACGUCAUAGUCAUAAA | 674 | 1842-1864 |
| AD-1725778 | AUGACUAUGACGUUGCCCUGU | 282 | 1845-1865 | ACAGGGCAACGUCAUAGUCAUAA | 675 | 1843-1865 |
| AD-1725779 | UGACUAUGACGUUGCCCUGAU | 283 | 1846-1866 | ATCAGGGCAACGUCAUAGUCAUA | 676 | 1844-1866 |
| AD-1725780 | GACUAUGACGUUGCCCUGAUU | 284 | 1847-1867 | AAUCAGGGCAACGUCAUAGUCAU | 677 | 1845-1867 |
| AD-1725784 | AUGACGUUGCCCUGAUCAAGU | 285 | 1851-1871 | ACUUGAUCAGGGCAACGUCAUAG | 678 | 1849-1871 |
| AD-1725785 | UGACGUUGCCCUGAUCAAGCU | 286 | 1852-1872 | AGCUTGAUCAGGGCAACGUCAUA | 679 | 1850-1872 |

TABLE 2-continued

Unmodified Sense and Antisense Strand Sequences of Complement Factor B dsRNA Agents

| Duplex Name | Sense Strand Sequence 5' to 3' | SEQ ID NO: | Range in NM_001710.6 | Antisense Strand Sequence 5' to 3' | SEQ ID NO: | Range in NM_001710.6 |
|---|---|---|---|---|---|---|
| AD-1725786 | GACGUUGCCCUGAUCAAGCUU | 287 | 1853-1873 | AAGCUUGAUCAGGGCAACGUCAU | 680 | 1851-1873 |
| AD-1725787 | ACGUUGCCCUGAUCAAGCUCU | 288 | 1854-1874 | AGAGCUTGAUCAGGGCAACGUCA | 681 | 1852-1874 |
| AD-1725789 | GUUGCCCUGAUCAAGCUCAAU | 289 | 1856-1876 | ATUGAGCUUGATCAGGGCAACGU | 682 | 1854-1876 |
| AD-1725790 | UUGCCCUGAUCAAGCUCAAGU | 290 | 1857-1877 | ACUUGAGCUUGAUCAGGGCAACG | 683 | 1855-1877 |
| AD-1725828 | CAGACUAUCAGGCCCAUUUGU | 291 | 1895-1915 | ACAAAUGGGCCTGAUAGUCUGGC | 684 | 1893-1915 |
| AD-1725829 | AGACUAUCAGGCCCAUUUGUU | 292 | 1896-1916 | AACAAATGGGCCUGAUAGUCUGG | 685 | 1894-1916 |
| AD-1725830 | GACUAUCAGGCCCAUUUGUCU | 293 | 1897-1917 | AGACAAAUGGGCCUGAUAGUCUG | 686 | 1895-1917 |
| AD-1725831 | ACUAUCAGGCCCAUUUGUCUU | 294 | 1898-1918 | AAGACAAAUGGGCCUGAUAGUCU | 687 | 1896-1918 |
| AD-1725832 | CUAUCAGGCCCAUUUGUCUCU | 295 | 1899-1919 | AGAGACAAAUGGGCCUGAUAGUC | 688 | 1897-1919 |
| AD-1725840 | CGAGGGAACAACUCGAGCUUU | 296 | 1927-1947 | AAAGCUCGAGUTGUUCCCUCGGU | 689 | 1925-1947 |
| AD-1725841 | GAGGGAACAACUCGAGCUUUU | 297 | 1928-1948 | AAAAGCUCGAGTUGUUCCCUCGG | 690 | 1926-1948 |
| AD-1725842 | AGGGAACAACUCGAGCUUUGU | 298 | 1929-1949 | ACAAAGCUCGAGUUGUUCCCUCG | 691 | 1927-1949 |
| AD-1725845 | GAACAACUCGAGCUUUGAGGU | 299 | 1932-1952 | ACCUCAAAGCUCGAGUUGUUCCC | 692 | 1930-1952 |
| AD-1725846 | AACAACUCGAGCUUUGAGGCU | 300 | 1933-1953 | AGCCUCAAAGCUCGAGUUGUUCC | 693 | 1931-1953 |
| AD-1725848 | CAACUCGAGCUUUGAGGCUUU | 301 | 1935-1955 | AAAGCCUCAAAGCUCGAGUUGUU | 694 | 1933-1955 |
| AD-1725849 | AACUCGAGCUUUGAGGCUUCU | 302 | 1936-1956 | AGAAGCCUCAAAGCUCGAGUUGU | 695 | 1934-1956 |
| AD-1725850 | ACUCGAGCUUUGAGGCUUCCU | 303 | 1937-1957 | AGGAAGCCUCAAAGCUCGAGUUG | 696 | 1935-1957 |
| AD-1725854 | GAGCUUUGAGGCUUCCUCCAU | 304 | 1941-1961 | ATGGAGGAAGCCUCAAAGCUCGA | 697 | 1939-1961 |
| AD-1725855 | AGCUUUGAGGCUUCCUCCAAU | 305 | 1942-1962 | ATUGGAGGAAGCCUCAAAGCUCG | 698 | 1940-1962 |
| AD-1725856 | GCUUUGAGGCUUCCUCCAACU | 306 | 1943-1963 | AGUUGGAGGAAGCCUCAAAGCUC | 699 | 1941-1963 |
| AD-1725857 | CUUUGAGGCUUCCUCCAACUU | 307 | 1944-1964 | AAGUUGGAGGAAGCCUCAAAGCU | 700 | 1942-1964 |
| AD-1725858 | UUUGAGGCUUCCUCCAACUAU | 308 | 1945-1965 | ATAGUUGGAGGAAGCCUCAAAGC | 701 | 1943-1965 |
| AD-1725861 | GAGGCUUCCUCCAACUACCAU | 309 | 1948-1968 | ATGGUAGUUGGAGGAAGCCUCAA | 702 | 1946-1968 |
| AD-1725862 | AGGCUUCCUCCAACUACCACU | 310 | 1949-1969 | AGUGGUAGUUGGAGGAAGCCUCA | 703 | 1947-1969 |
| AD-1725864 | GCUUCCUCCAACUACCACUUU | 311 | 1951-1971 | AAAGTGGUAGUTGGAGGAAGCCU | 704 | 1949-1971 |
| AD-1725866 | UUCCUCCAACUACCACUUGCU | 312 | 1953-1973 | AGCAAGTGGUAGUUGGAGGAAGC | 705 | 1951-1973 |
| AD-1725867 | UCCUCCAACUACCACUUGCCU | 313 | 1954-1974 | AGGCAAGUGGUAGUUGGAGGAAG | 706 | 1952-1974 |
| AD-1725872 | CAACUACCACUUGCCAGCAAU | 314 | 1959-1979 | ATUGCUGGCAAGUGGUAGUUGGA | 707 | 1957-1979 |
| AD-1725874 | ACUACCACUUGCCAGCAACAU | 315 | 1961-1981 | ATGUUGCUGGCAAGUGGUAGUUG | 708 | 1959-1981 |
| AD-1725907 | CUCCCUGCACAGGAUAUCAAU | 316 | 1994-2014 | ATUGAUAUCCUGUGCAGGGAGCA | 709 | 1992-2014 |
| AD-1725908 | UCCCUGCACAGGAUAUCAAAU | 317 | 1995-2015 | ATUUGAUAUCCUGUGCAGGGAGC | 710 | 1993-2015 |
| AD-1725909 | CCCUGCACAGGAUAUCAAAGU | 318 | 1996-2016 | ACUUGAUAUCCUGUGCAGGGAG | 711 | 1994-2016 |
| AD-1725911 | CUGCACAGGAUAUCAAAGCUU | 319 | 1998-2018 | AAGCUUTGAUAUCCUGUGCAGGG | 712 | 1996-2018 |
| AD-1725916 | CAGGAUAUCAAAGCUCUGUUU | 320 | 2003-2023 | AAACAGAGCUUTGAUAUCCUGUG | 713 | 2001-2023 |
| AD-1725919 | GAUAUCAAAGCUCUGUUUGUU | 321 | 2006-2026 | AACAAACAGAGCUUUGAUAUCCU | 714 | 2004-2026 |
| AD-1725925 | AAAGCUCUGUUUGUGUCUGAU | 322 | 2012-2032 | ATCAGACACAAACAGAGCUUUGA | 715 | 2010-2032 |
| AD-1725957 | GCUGACUCGGAAGGAGGUCUU | 323 | 2044-2064 | AAGACCUCCUUCCGAGUCAGCUU | 716 | 2042-2064 |

TABLE 2-continued

Unmodified Sense and Antisense Strand Sequences of Complement Factor B dsRNA Agents

| Duplex Name | Sense Strand Sequence 5' to 3' | SEQ ID NO: | Range in NM_001710.6 | Antisense Strand Sequence 5' to 3' | SEQ ID NO: | Range in NM_001710.6 |
|---|---|---|---|---|---|---|
| AD-1725958 | CUGACUCGGAAGGAGGUCUAU | 324 | 2045-2065 | ATAGACCUCCUUCCGAGUCAGCU | 717 | 2043-2065 |
| AD-1725961 | ACUCGGAAGGAGGUCUACAUU | 325 | 2048-2068 | AAUGUAGACCUCCUUCCGAGUCA | 718 | 2046-2068 |
| AD-1725963 | UCGGAAGGAGGUCUACAUCAU | 326 | 2050-2070 | ATGATGTAGACCUCCUUCCGAGU | 719 | 2048-2070 |
| AD-1725964 | CGGAAGGAGGUCUACAUCAAU | 327 | 2051-2071 | ATUGAUGUAGACCUCCUUCCGAG | 720 | 2049-2071 |
| AD-1725967 | AAGGAGGUCUACAUCAAGAAU | 328 | 2054-2074 | ATUCUGAUGUAGACCUCCUUCC | 721 | 2052-2074 |
| AD-1725968 | AGGAGGUCUACAUCAAGAAUU | 329 | 2055-2075 | AAUUCUUGAUGUAGACCUCCUUC | 722 | 2053-2075 |
| AD-1725974 | AAGAAAGGCAGCUGUGAGAGU | 330 | 2081-2101 | ACUCUCACAGCUGCCUUUCUUAU | 723 | 2079-2101 |
| AD-1725977 | AAAGGCAGCUGUGAGAGAGAU | 331 | 2084-2104 | ATCUCUCUCACAGCUGCCUUUCU | 724 | 2082-2104 |
| AD-1725983 | AGCUGUGAGAGAGAUGCUCAU | 332 | 2090-2110 | ATGAGCAUCUCUCUCACAGCUGC | 725 | 2088-2110 |
| AD-1725985 | CUGUGAGAGAGAUGCUCAAUU | 333 | 2092-2112 | AAUUGAGCAUCUCUCUCACAGCU | 726 | 2090-2112 |
| AD-1725986 | UGUGAGAGAGAUGCUCAAUAU | 334 | 2093-2113 | ATAUUGAGCAUCUCUCUCACAGC | 727 | 2091-2113 |
| AD-1725987 | GUGAGAGAGAUGCUCAAUAUU | 335 | 2094-2114 | AAUAUUGAGCATCUCUCUCACAG | 728 | 2092-2114 |
| AD-1725988 | UGAGAGAGAUGCUCAAUAUGU | 336 | 2095-2115 | ACAUAUUGAGCAUCUCUCUCACA | 729 | 2093-2115 |
| AD-1725989 | GAGAGAGAUGCUCAAUAUGCU | 337 | 2096-2116 | AGCAUAUUGAGCAUCUCUCUCAC | 730 | 2094-2116 |
| AD-1725991 | CAGGCUAUGACAAAGUCAAGU | 338 | 2118-2138 | ACUUGACUUUGUCAUAGCCUGGG | 731 | 2116-2138 |
| AD-1725992 | AGGCUAUGACAAAGUCAAGGU | 339 | 2119-2139 | ACCUUGACUUUGUCAUAGCCUGG | 732 | 2117-2139 |
| AD-1725993 | GGCUAUGACAAAGUCAAGGAU | 340 | 2120-2140 | ATCCUUGACUUUGUCAUAGCCUG | 733 | 2118-2140 |
| AD-1725999 | GACAAAGUCAAGGACAUCUCU | 341 | 2126-2146 | AGAGAUGUCCUUGACUUUGUCAU | 734 | 2124-2146 |
| AD-1726014 | UCGGUUCCUUUGUACUGGAGU | 342 | 2161-2181 | ACUCCAGUACAAAGGAACCGAGG | 735 | 2159-2181 |
| AD-1726015 | CGGUUCCUUUGUACUGGAGGU | 343 | 2162-2182 | ACCUCCAGUACAAAGGAACCGAG | 736 | 2160-2182 |
| AD-1726016 | GGUUCCUUUGUACUGGAGGAU | 344 | 2163-2183 | ATCCUCCAGUACAAAGGAACCGA | 737 | 2161-2183 |
| AD-1726018 | UUCCUUUGUACUGGAGGAGUU | 345 | 2165-2185 | AACUCCUCCAGUACAAAGGAACC | 738 | 2163-2185 |
| AD-1726020 | CCUUUGUACUGGAGGAGUGAU | 346 | 2167-2187 | ATCACUCCUCCAGUACAAAGGAA | 739 | 2165-2187 |
| AD-1726023 | UUGUACUGGAGGAGUGAGUCU | 347 | 2170-2190 | AGACUCACUCCUCCAGUACAAAG | 740 | 2168-2190 |
| AD-1726024 | UGUACUGGAGGAGUGAGUCCU | 348 | 2171-2191 | AGGACUCACUCCUCCAGUACAAA | 741 | 2169-2191 |
| AD-1726025 | GUACUGGAGGAGUGAGUCCCU | 349 | 2172-2192 | AGGGACUCACUCCUCCAGUACAA | 742 | 2170-2192 |
| AD-1726027 | ACUGGAGGAGUGAGUCCCUAU | 350 | 2174-2194 | ATAGGGACUCACUCCUCCAGUAC | 743 | 2172-2194 |
| AD-1726029 | UGGAGGAGUGAGUCCCUAUGU | 351 | 2176-2196 | ACAUAGGGACUCACUCCUCCAGU | 744 | 2174-2196 |
| AD-1726031 | GAGGAGUGAGUCCCUAUGCUU | 352 | 2178-2198 | AAGCAUAGGGACUCACUCCUCCA | 745 | 2176-2198 |
| AD-1726033 | GGAGUGAGUCCCUAUGCUGAU | 353 | 2180-2200 | ATCAGCAUAGGGACUCACUCCUC | 746 | 2178-2200 |
| AD-1726034 | GAGUGAGUCCCUAUGCUGACU | 354 | 2181-2201 | AGUCAGCAUAGGGACUCACUCCU | 747 | 2179-2201 |
| AD-1726036 | CAAUACUUGCAGAGGUGAUUU | 355 | 2203-2223 | AAAUCACCUCUGCAAGUAUUGGG | 748 | 2201-2223 |
| AD-1726037 | AAUACUUGCAGAGGUGAUUCU | 356 | 2204-2224 | AGAAUCACCUCUGCAAGUAUUGG | 749 | 2202-2224 |
| AD-1726039 | UACUUGCAGAGGUGAUUCUGU | 357 | 2206-2226 | ACAGAAUCACCUCUGCAAGUAUU | 750 | 2204-2226 |
| AD-1726041 | CUUGCAGAGGUGAUUCUGGCU | 358 | 2208-2228 | AGCCAGAAUCACCUCUGCAAGUA | 751 | 2206-2228 |
| AD-1726042 | UUGCAGAGGUGAUUCUGGCGU | 359 | 2209-2229 | ACGCCAGAAUCACCUCUGCAAGU | 752 | 2207-2229 |
| AD-1726048 | UGAUAGUUCACAAGAGAAGUU | 360 | 2235-2255 | AACUUCUCUUGUGAACUAUCAAG | 753 | 2233-2255 |

TABLE 2-continued

Unmodified Sense and Antisense Strand Sequences of Complement Factor B dsRNA Agents

| Duplex Name | Sense Strand Sequence 5' to 3' | SEQ ID NO: | Range in NM_001710.6 | Antisense Strand Sequence 5' to 3' | SEQ ID NO: | Range in NM_001710.6 |
| --- | --- | --- | --- | --- | --- | --- |
| AD-1726049 | GAUAGUUCACAAGAGAAGUCU | 361 | 2236-2256 | AGACUUCUCUUGUGAACUAUCAA | 754 | 2234-2256 |
| AD-1726050 | AUAGUUCACAAGAGAAGUCGU | 362 | 2237-2257 | ACGACUUCUCUUGUGAACUAUCA | 755 | 2235-2257 |
| AD-1726051 | UAGUUCACAAGAGAAGUCGUU | 363 | 2238-2258 | AACGACUUCUCUUGUGAACUAUC | 756 | 2236-2258 |
| AD-1726052 | AGUUCACAAGAGAAGUCGUUU | 364 | 2239-2259 | AAACGACUUCUCUUGUGAACUAU | 757 | 2237-2259 |
| AD-1726053 | GUUCACAAGAGAAGUCGUUUU | 365 | 2240-2260 | AAAACGACUUCUCUUGUGAACUA | 758 | 2238-2260 |
| AD-1726054 | UUCACAAGAGAAGUCGUUUCU | 366 | 2241-2261 | AGAAACGACUUCUCUUGUGAACU | 759 | 2239-2261 |
| AD-1726055 | UCACAAGAGAAGUCGUUUCAU | 367 | 2242-2262 | AUGAAACGACUUCUCUUGUGAAC | 760 | 2240-2262 |
| AD-1726056 | CACAAGAGAAGUCGUUUCAUU | 368 | 2243-2263 | AAUGAAACGACUUCUCUUGUGAA | 761 | 2241-2263 |
| AD-1726057 | ACAAGAGAAGUCGUUUCAUUU | 369 | 2244-2264 | AAAUGAAACGACUUCUCUUGUGA | 762 | 2242-2264 |
| AD-1726058 | CAAGAGAAGUCGUUUCAUUCU | 370 | 2245-2265 | AGAAUGAAACGACUUCUCUUGUG | 763 | 2243-2265 |
| AD-1726059 | AAGAGAAGUCGUUUCAUUCAU | 371 | 2246-2266 | AUGAAUGAAACGACUUCUCUUGU | 764 | 2244-2266 |
| AD-1726060 | AGAGAAGUCGUUUCAUUCAAU | 372 | 2247-2267 | AUUGAAUGAAACGACUUCUCUUG | 765 | 2245-2267 |
| AD-1726061 | GAGAAGUCGUUUCAUUCAAGU | 373 | 2248-2268 | ACUUGAAUGAAACGACUUCUCUU | 766 | 2246-2268 |
| AD-1726062 | AGAAGUCGUUUCAUUCAAGUU | 374 | 2249-2269 | AACUUGAAUGAAACGACUUCUCU | 767 | 2247-2269 |
| AD-1726063 | GAAGUCGUUUCAUUCAAGUUU | 375 | 2250-2270 | AAACUUGAAUGAAACGACUUCUC | 768 | 2248-2270 |
| AD-1726064 | AAGUCGUUUCAUUCAAGUUGU | 376 | 2251-2271 | ACAACUUGAAUGAAACGACUUCU | 769 | 2249-2271 |
| AD-1726065 | AGUCGUUUCAUUCAAGUUGGU | 377 | 2252-2272 | ACCAACUUGAAUGAAACGACUUC | 770 | 2250-2272 |
| AD-1726079 | GAGUAGUGGAUGUCUGCAAAU | 378 | 2286-2306 | AUUUGCAGACAUCCACUACUCCC | 771 | 2284-2306 |
| AD-1726080 | AGUAGUGGAUGUCUGCAAAAU | 379 | 2287-2307 | AUUUUGCAGACAUCCACUACUCC | 772 | 2285-2307 |
| AD-1726081 | GUAGUGGAUGUCUGCAAAAAU | 380 | 2288-2308 | AUUUUUGCAGACAUCCACUACUC | 773 | 2286-2308 |
| AD-1726082 | UAGUGGAUGUCUGCAAAAACU | 381 | 2289-2309 | AGUUUUGCAGACAUCCACUACU | 774 | 2287-2309 |
| AD-1726083 | AGUGGAUGUCUGCAAAAACCU | 382 | 2290-2310 | AGGUUUUGCAGACAUCCACUAC | 775 | 2288-2310 |
| AD-1726084 | GUGGAUGUCUGCAAAAACCAU | 383 | 2291-2311 | AUGGUUUUGCAGACAUCCACUA | 776 | 2289-2311 |
| AD-1726085 | UGGAUGUCUGCAAAAACCAGU | 384 | 2292-2312 | ACUGGUUUUGCAGACAUCCACU | 777 | 2290-2312 |
| AD-1726086 | GGAUGUCUGCAAAAACCAGAU | 385 | 2293-2313 | AUCUGGUUUUGCAGACAUCCAC | 778 | 2291-2313 |
| AD-1726087 | GAUGUCUGCAAAAACCAGAAU | 386 | 2294-2314 | AUUCUGGUUUUGCAGACAUCCA | 779 | 2292-2314 |
| AD-1726090 | GUCUGCAAAAACCAGAAGCGU | 387 | 2297-2317 | ACGCUUCUGGUUUUUGCAGACAU | 780 | 2295-2317 |
| AD-1726091 | UCUGCAAAAACCAGAAGCGGU | 388 | 2298-2318 | ACCGCUUCUGGUUUUUGCAGACA | 781 | 2296-2318 |
| AD-1726092 | CUGCAAAAACCAGAAGCGGCU | 389 | 2299-2319 | AGCCGCUUCUGGUUUUUGCAGAC | 782 | 2297-2319 |
| AD-1726095 | CAAAAACCAGAAGCGGCAAAU | 390 | 2302-2322 | AUUUGCCGCUUCUGGUUUUUGCA | 783 | 2300-2322 |
| AD-1726096 | AAAAACCAGAAGCGGCAAAAU | 391 | 2303-2323 | AUUUUGCCGCUUCUGGUUUUUGC | 784 | 2301-2323 |
| AD-1726097 | AAAACCAGAAGCGGCAAAAGU | 392 | 2304-2324 | ACUUUUGCCGCUUCUGGUUUUUG | 785 | 2302-2324 |
| AD-1726098 | AAACCAGAAGCGGCAAAAGCU | 393 | 2305-2325 | AGCUUUUGCCGCUUCUGGUUUUU | 786 | 2303-2325 |
| AD-1726099 | AACCAGAAGCGGCAAAAGCAU | 394 | 2306-2326 | AUGCUUUUGCCGCUUCUGGUUUU | 787 | 2304-2326 |
| AD-1726103 | AGAAGCGGCAAAAGCAGGUAU | 395 | 2310-2330 | AUACCUGCUUUUGCCGCUUCUGG | 788 | 2308-2330 |
| AD-1726113 | AAAGCAGGUACCUGCUCACGU | 396 | 2320-2340 | ACGUGAGCAGGUACCUGCUUUUG | 789 | 2318-2340 |
| AD-1726159 | CAAGUGCUGCCCUGGCUGAAU | 397 | 2366-2386 | AUUCAGCCAGGGCAGCACUUGAA | 790 | 2364-2386 |

TABLE 2-continued

Unmodified Sense and Antisense Strand Sequences of Complement Factor B dsRNA Agents

| Duplex Name | Sense Strand Sequence 5' to 3' | SEQ ID NO: | Range in NM_001710.6 | Antisense Strand Sequence 5' to 3' | SEQ ID NO: | Range in NM_001710.6 |
|---|---|---|---|---|---|---|
| AD-1726171 | UGGCUGAAGGAGAAACUCCAU | 398 | 2378-2398 | ATGGAGTUUCUCCUUCAGCCAGG | 791 | 2376-2398 |
| AD-1726184 | AACUCCAAGAUGAGGAUUUGU | 399 | 2391-2411 | ACAAAUCCUCAUCUUGGAGUUUC | 792 | 2389-2411 |
| AD-1726187 | UCCAAGAUGAGGAUUUGGGUU | 400 | 2394-2414 | AACCCAAAUCCTCAUCUUGGAGU | 793 | 2392-2414 |
| AD-1726189 | CAAGAUGAGGAUUUGGGUUUU | 401 | 2396-2416 | AAAACCCAAAUCCUCAUCUUGGA | 794 | 2394-2416 |
| AD-1726191 | AGAUGAGGAUUUGGGUUUUCU | 402 | 2398-2418 | AGAAAACCCAAAUCCUCAUCUUG | 795 | 2396-2418 |
| AD-1726201 | GUGGGAUUGAAUUAAAACAGU | 403 | 2446-2466 | ACUGTUUAAUTCAAUCCCACGC | 796 | 2444-2466 |
| AD-1726202 | UGGGAUUGAAUUAAAACAGCU | 404 | 2447-2467 | AGCUGTUUUAAUUCAAUCCCACG | 797 | 2445-2467 |
| AD-1726203 | GGGAUUGAAUUAAAACAGCUU | 405 | 2448-2468 | AAGCTGTUUUAAUUCAAUCCCAC | 798 | 2446-2468 |
| AD-1726206 | AUUGAAUUAAAACAGCUGCGU | 406 | 2451-2471 | ACGCAGCUGUUUAAUUCAAUCC | 799 | 2449-2471 |
| AD-1726207 | UUGAAUUAAAACAGCUGCGAU | 407 | 2452-2472 | ATCGCAGCUGUUUAAUUCAAUC | 800 | 2450-2472 |
| AD-1726208 | UGAAUUAAAACAGCUGCGACU | 408 | 2453-2473 | AGUCGCAGCUGUUUUAAUUCAAU | 801 | 2451-2473 |
| AD-1726209 | GAAUUAAAACAGCUGCGACAU | 409 | 2454-2474 | ATGUCGCAGCUGUUUUAAUUCAA | 802 | 2452-2474 |
| AD-1726815 | CUGGCUUCUACCCGUACCCUU | 34 | 469-489 | AAGGGUACGGGUAGAAGCCAGAA | 803 | 467-489 |
| AD-1726927 | CCCUACUACAAUGUGAGUGAU | 40 | 633-653 | AUCACUCACAUUGUAGUAGGGAG | 804 | 631-653 |
| AD-1726928 | CCUACUACAAUGUGAGUGAUU | 41 | 634-654 | AAUCACUCACAUUGUAGUAGGGA | 805 | 632-654 |
| AD-1726931 | ACUACAAUGUGAGUGAUGAGU | 43 | 637-657 | ACUCAUCACUCACAUUGUAGUAG | 436 | 635-657 |
| AD-1726934 | ACAAUGUGAGUGAUGAGAUCU | 44 | 640-660 | AGAUCUCAUCACUCACAUUGUAG | 437 | 638-660 |
| AD-1726935 | CAAUGUGAGUGAUGAGAUCUU | 45 | 641-661 | AAGAUCUCAUCACUCACAUUGUA | 806 | 639-661 |
| AD-1726936 | AAUGUGAGUGAUGAGAUCUCU | 46 | 642-662 | AGAGAUCUCAUCACUCACAUUGU | 439 | 640-662 |
| AD-1726937 | AUGUGAGUGAUGAGAUCUCUU | 47 | 643-663 | AAGAGAUCUCAUCACUCACAUUG | 807 | 641-663 |
| AD-1726938 | UGUGAGUGAUGAGAUCUCUUU | 48 | 644-664 | AAAGAGAUCUCAUCACUCACAUU | 441 | 642-664 |
| AD-1726939 | GUGAGUGAUGAGAUCUCUUUU | 49 | 645-665 | AAAAGAGAUCUCAUCACUCACAU | 442 | 643-665 |
| AD-1726940 | UGAGUGAUGAGAUCUCUUUCU | 50 | 646-666 | AGAAAGAGAUCUCAUCACUCACA | 808 | 644-666 |
| AD-1726941 | GAGUGAUGAGAUCUCUUUCCU | 51 | 647-667 | AGGAAAGAGAUCUCAUCACUCAC | 444 | 645-667 |
| AD-1726942 | AGUGAUGAGAUCUCUUUCCAU | 52 | 648-668 | AUGGAAAGAGAUCUCAUCACUCA | 809 | 646-668 |
| AD-1726944 | UGAUGAGAUCUCUUUCCACUU | 54 | 650-670 | AAGUGGAAAGAGAUCUCAUCACU | 447 | 648-670 |
| AD-1726952 | UCUCUUUCCACUGCUAUGACU | 57 | 658-678 | AGUCAUAGCAGUGGAAAGAGAUC | 810 | 656-678 |
| AD-1726961 | ACUGCUAUGACGGUUACACUU | 60 | 667-687 | AAGUGUAACCGUCAUAGCAGUGG | 811 | 665-687 |
| AD-1727012 | CAGACAGCGAUCUGUGACAAU | 67 | 738-758 | AUUGUCACAGAUCGCUGUCUGCC | 812 | 736-758 |
| AD-1727059 | CUUGAAGACAGCGUCACCUAU | 75 | 825-845 | AUAGGUGACGCUGUCUUCAAGGC | 813 | 823-845 |
| AD-1727140 | AAGACUCCUUCAUGUACGACU | 84 | 934-954 | AGUCGUACAUGAAGGAGUCUUGG | 477 | 932-954 |
| AD-1727142 | GACUCCUUCAUGUACGACACU | 86 | 936-956 | AGUGUCGUACAUGAAGGAGUCUU | 814 | 934-956 |
| AD-1727181 | AGAGACCAUAGAAGGAGUCGU | 89 | 995-1015 | ACGACUCCUUCUAUGGUCUCUGU | 815 | 993-1015 |
| AD-1727183 | AGACCAUAGAAGGAGUCGAUU | 91 | 997-1017 | AAUCGACUCCUUCUAUGGUCUCU | 816 | 995-1017 |
| AD-1727184 | GACCAUAGAAGGAGUCGAUGU | 92 | 998-1018 | ACAUCGACUCCUUCUAUGGUCUC | 817 | 996-1018 |
| AD-1727249 | UGAACAUCUACCUGGUGCUAU | 97 | 1084-1104 | AUAGCACCAGGUAGAUGUUCAUG | 818 | 1082-1104 |
| AD-1727261 | UGGUGCUAGAUGGAUCAGACU | 106 | 1096-1116 | AGUCUGAUCCAUCUAGCACCAGG | 819 | 1094-1116 |

TABLE 2-continued

Unmodified Sense and Antisense Strand Sequences of Complement Factor B dsRNA Agents

| Duplex Name | Sense Strand Sequence 5' to 3' | SEQ ID NO: | Range in NM_001710.6 | Antisense Strand Sequence 5' to 3' | SEQ ID NO: | Range in NM_001710.6 |
|---|---|---|---|---|---|---|
| AD-1727263 | GUGCUAGAUGGAUCAGACAGU | 107 | 1098-1118 | ACUGUCUGAUCCAUCUAGCACCA | 820 | 1096-1118 |
| AD-1727275 | CAACUUCACAGGAGCCAAAAU | 110 | 1130-1150 | AUUUUGGCUCCUGUGAAGUUGCU | 821 | 1128-1150 |
| AD-1727276 | AACUUCACAGGAGCCAAAAAU | 111 | 1131-1151 | AUUUUUGGCUCCUGUGAAGUUGC | 822 | 1129-1151 |
| AD-1727278 | CUUCACAGGAGCCAAAAAGUU | 113 | 1133-1153 | AACUUUUUGGCUCCUGUGAAGUU | 823 | 1131-1153 |
| AD-1727285 | GGAGCCAAAAAGUGUCUAGUU | 120 | 1140-1160 | AACUAGACACUUUUUGGCUCCUG | 824 | 1138-1160 |
| AD-1727286 | GAGCCAAAAAGUGUCUAGUCU | 121 | 1141-1161 | AGACUAGACACUUUUUGGCUCCU | 825 | 1139-1161 |
| AD-1727288 | GCCAAAAAGUGUCUAGUCAAU | 123 | 1143-1163 | AUUGACUAGACACUUUUUGGCUC | 826 | 1141-1163 |
| AD-1727289 | CCAAAAAGUGUCUAGUCAACU | 124 | 1144-1164 | AGUUGACUAGACACUUUUUGGCU | 517 | 1142-1164 |
| AD-1727290 | CAAAAAGUGUCUAGUCAACUU | 125 | 1145-1165 | AAGUUGACUAGACACUUUUUGGC | 827 | 1143-1165 |
| AD-1727291 | AAAAAGUGUCUAGUCAACUUU | 126 | 1146-1166 | AAAGUUGACUAGACACUUUUUGG | 828 | 1144-1166 |
| AD-1727292 | AAAAGUGUCUAGUCAACUUAU | 127 | 1147-1167 | AUAAGUUGACUAGACACUUUUUG | 829 | 1145-1167 |
| AD-1727293 | AAAGUGUCUAGUCAACUUAAU | 128 | 1148-1168 | AUUAAGUUGACUAGACACUUUUU | 830 | 1146-1168 |
| AD-1727298 | GUCUAGUCAACUUAAUUGAGU | 133 | 1153-1173 | ACUCAAUUAAGUUGACUAGACAC | 831 | 1151-1173 |
| AD-1727310 | UAAUUGAGAAGGUGGCAAGUU | 135 | 1165-1185 | AACUUGCCACCUUCUCAAUUAAG | 832 | 1163-1185 |
| AD-1727318 | AAGGUGGCAAGUUAUGGUGUU | 139 | 1173-1193 | AACACCAUAACUUGCCACCUUCU | 833 | 1171-1193 |
| AD-1727324 | GCAAGUUAUGGUGUGAAGCCU | 141 | 1179-1199 | AGGCUUCACACCAUAACUUGCCA | 834 | 1177-1199 |
| AD-1727331 | AUGGUGUGAAGCCAAGAUAUU | 143 | 1186-1206 | AAUAUCUUGGCUUCACACCAUAA | 835 | 1184-1206 |
| AD-1727358 | AAAAUUUGGGUCAAAGUGUCU | 145 | 1233-1253 | AGACACUUUGACCCAAAUUUUGG | 836 | 1231-1253 |
| AD-1727359 | AAAUUUGGGUCAAAGUGUCUU | 146 | 1234-1254 | AAGACACUUUGACCCAAAUUUUG | 539 | 1232-1254 |
| AD-1727361 | AUUUGGGUCAAAGUGUCUGAU | 147 | 1236-1256 | AUCAGACACUUUGACCCAAAUUU | 837 | 1234-1256 |
| AD-1727392 | GUAAUGCAGACUGGGUCACGU | 148 | 1267-1287 | ACGUGACCCAGUCUGCAUUACUG | 838 | 1265-1287 |
| AD-1727420 | AAUGAAAUCAAUUAUGAAGAU | 152 | 1296-1316 | AUCUUCAUAAUUGAUUUCAUUGA | 839 | 1294-1316 |
| AD-1727427 | UCAAUUAUGAAGACCACAAGU | 156 | 1303-1323 | ACUUGUGGUCUUCAUAAUUGAUU | 840 | 1301-1323 |
| AD-1727428 | CAAUUAUGAAGACCACAAGUU | 157 | 1304-1324 | AACUUGUGGUCUUCAUAAUUGAU | 841 | 1302-1324 |
| AD-1727430 | AUUAUGAAGACCACAAGUUGU | 159 | 1306-1326 | ACAACUUGUGGUCUUCAUAAUUG | 842 | 1304-1326 |
| AD-1727431 | UUAUGAAGACCACAAGUUGAU | 160 | 1307-1327 | AUCAACUUGUGGUCUUCAUAAUU | 843 | 1305-1327 |
| AD-1727432 | UAUGAAGACCACAAGUUGAAU | 161 | 1308-1328 | AUUCAACUUGUGGUCUUCAUAAU | 844 | 1306-1328 |
| AD-1727433 | AUGAAGACCACAAGUUGAAGU | 162 | 1309-1329 | ACUUCAACUUGUGGUCUUCAUAA | 845 | 1307-1329 |
| AD-1727434 | UGAAGACCACAAGUUGAAGUU | 163 | 1310-1330 | AACUUCAACUUGUGGUCUUCAUA | 846 | 1308-1330 |
| AD-1727435 | GAAGACCACAAGUUGAAGUCU | 164 | 1311-1331 | AGACUUCAACUUGUGGUCUUCAU | 847 | 1309-1331 |
| AD-1727436 | AAGACCACAAGUUGAAGUCAU | 165 | 1312-1332 | AUGACUUCAACUUGUGGUCUUCA | 848 | 1310-1332 |
| AD-1727441 | CACAAGUUGAAGUCAGGGACU | 169 | 1317-1337 | AGUCCCUGACUUCAACUUGUGGU | 849 | 1315-1337 |
| AD-1727442 | ACAAGUUGAAGUCAGGGACUU | 170 | 1318-1338 | AAGUCCCUGACUUCAACUUGUGG | 850 | 1316-1338 |
| AD-1727481 | AGGCAGUGUACAGCAUGAUGU | 178 | 1357-1377 | ACAUCAUGCUGUACACUGCCUGG | 851 | 1355-1377 |
| AD-1727483 | GCAGUGUACAGCAUGAUGAGU | 179 | 1359-1379 | ACUCAUCAUGCUGUACACUGCCU | 852 | 1357-1379 |
| AD-1727565 | GAUGGAUUGCACAACAUGGGU | 182 | 1443-1463 | ACCCAUGUUGUGCAAUCCAUCAG | 575 | 1441-1463 |
| AD-1727566 | AUGGAUUGCACAACAUGGGCU | 183 | 1444-1464 | AGCCCAUGUUGUGCAAUCCAUCA | 853 | 1442-1464 |

TABLE 2-continued

Unmodified Sense and Antisense Strand Sequences of Complement Factor B dsRNA Agents

| Duplex Name | Sense Strand Sequence 5' to 3' | SEQ ID NO: | Range in NM_001710.6 | Antisense Strand Sequence 5' to 3' | SEQ ID NO: | Range in NM_001710.6 |
|---|---|---|---|---|---|---|
| AD-1727568 | GGAUUGCACAACAUGGGCGGU | 185 | 1446-1466 | ACCGCCCAUGUUGUGCAAUCCAU | 854 | 1444-1466 |
| AD-1727569 | GACCCAAUUACUGUCAUUGAU | 186 | 1467-1487 | AUCAAUGACAGUAAUUGGGUCCC | 855 | 1465-1487 |
| AD-1727570 | ACCCAAUUACUGUCAUUGAUU | 187 | 1468-1488 | AAUCAAUGACAGUAAUUGGGUCC | 856 | 1466-1488 |
| AD-1727572 | CCAAUUACUGUCAUUGAUGAU | 188 | 1470-1490 | AUCAUCAAUGACAGUAAUUGGGU | 857 | 1468-1490 |
| AD-1727584 | AUUGAUGAGAUCCGGGACUUU | 192 | 1482-1502 | AAAGUCCCGGAUCUCAUCAAUGA | 858 | 1480-1502 |
| AD-1727612 | UUGGCAAGGAUCGCAAAAACU | 193 | 1510-1530 | AGUUUUUGCGAUCCUUGCCAAUG | 859 | 1508-1530 |
| AD-1727633 | CAAGGGAGGAUUAUCUGGAUU | 196 | 1531-1551 | AAUCCAGAUAAUCCUCCCUUGGG | 860 | 1529-1551 |
| AD-1727638 | GAGGAUUAUCUGGAUGUCUAU | 197 | 1536-1556 | AUAGACAUCCAGAUAAUCCUCCC | 861 | 1534-1556 |
| AD-1727639 | AGGAUUAUCUGGAUGUCUAUU | 198 | 1537-1557 | AAUAGACAUCCAGAUAAUCCUCC | 591 | 1535-1557 |
| AD-1727640 | GGAUUAUCUGGAUGUCUAUGU | 199 | 1538-1558 | ACAUAGACAUCCAGAUAAUCCUC | 592 | 1536-1558 |
| AD-1727641 | GAUUAUCUGGAUGUCUAUGUU | 200 | 1539-1559 | AACAUAGACAUCCAGAUAAUCCU | 862 | 1537-1559 |
| AD-1727642 | AUUAUCUGGAUGUCUAUGUGU | 201 | 1540-1560 | ACACAUAGACAUCCAGAUAAUCC | 863 | 1538-1560 |
| AD-1727643 | UUAUCUGGAUGUCUAUGUGUU | 202 | 1541-1561 | AACACAUAGACAUCCAGAUAAUC | 864 | 1539-1561 |
| AD-1727644 | UAUCUGGAUGUCUAUGUGUUU | 203 | 1542-1562 | AAACACAUAGACAUCCAGAUAAU | 596 | 1540-1562 |
| AD-1727645 | AUCUGGAUGUCUAUGUGUUUU | 204 | 1543-1563 | AAAACACAUAGACAUCCAGAUAA | 597 | 1541-1563 |
| AD-1727646 | UCUGGAUGUCUAUGUGUUUGU | 205 | 1544-1564 | ACAAACACAUAGACAUCCAGAUA | 598 | 1542-1564 |
| AD-1727663 | AACCAAGUGAACAUCAAUGCU | 207 | 1581-1601 | AGCAUUGAUGUUCACUUGGUUCA | 865 | 1579-1601 |
| AD-1727664 | ACCAAGUGAACAUCAAUGCUU | 208 | 1582-1602 | AAGCAUUGAUGUUCACUUGGUUC | 866 | 1580-1602 |
| AD-1727665 | CCAAGUGAACAUCAAUGCUUU | 209 | 1583-1603 | AAAGCAUUGAUGUUCACUUGGUU | 867 | 1581-1603 |
| AD-1727666 | CAAGUGAACAUCAAUGCUUUU | 210 | 1584-1604 | AAAAGCAUUGAUGUUCACUUGGU | 868 | 1582-1604 |
| AD-1727675 | AUCAAUGCUUUGGCUUCCAAU | 211 | 1593-1613 | AUUGGAAGCCAAAGCAUUGAUGU | 869 | 1591-1613 |
| AD-1727677 | CAAUGCUUUGGCUUCCAAGAU | 213 | 1595-1615 | AUCUUGGAAGCCAAAGCAUUGAU | 870 | 1593-1615 |
| AD-1727685 | UGGCUUCCAAGAAAGACAAUU | 214 | 1603-1623 | AAUUGUCUUUCUUGGAAGCCAAA | 871 | 1601-1623 |
| AD-1727689 | UUCCAAGAAAGACAAUGAGCU | 215 | 1607-1627 | AGCUCAUUGUCUUUCUUGGAAGC | 872 | 1605-1627 |
| AD-1727690 | UCCAAGAAAGACAAUGAGCAU | 216 | 1608-1628 | AUGCUCAUUGUCUUUCUUGGAAG | 873 | 1606-1628 |
| AD-1727693 | AAGAAAGACAAUGAGCAACAU | 218 | 1611-1631 | AUGUUGCUCAUUGUCUUUCUUGG | 874 | 1609-1631 |
| AD-1727696 | AAAGACAAUGAGCAACAUGUU | 219 | 1614-1634 | AACAUGUUGCUCAUUGUCUUUCU | 875 | 1612-1634 |
| AD-1727698 | AGACAAUGAGCAACAUGUGUU | 220 | 1616-1636 | AACACAUGUUGCUCAUUGUCUUU | 876 | 1614-1636 |
| AD-1727699 | GACAAUGAGCAACAUGUGUUU | 221 | 1617-1637 | AAACACAUGUUGCUCAUUGUCUU | 614 | 1615-1637 |
| AD-1727700 | ACAAUGAGCAACAUGUGUUCU | 222 | 1618-1638 | AGAACACAUGUUGCUCAUUGUCU | 877 | 1616-1638 |
| AD-1727701 | CAAUGAGCAACAUGUGUUCAU | 223 | 1619-1639 | AUGAACACAUGUUGCUCAUUGUC | 878 | 1617-1639 |
| AD-1727703 | AUGAGCAACAUGUGUUCAAAU | 224 | 1621-1641 | AUUUGAACACAUGUUGCUCAUUG | 879 | 1619-1641 |
| AD-1727705 | GAGCAACAUGUGUUCAAAGUU | 225 | 1623-1643 | AACUUUGAACACAUGUUGCUCAU | 880 | 1621-1643 |
| AD-1727708 | CAACAUGUGUUCAAAGUCAAU | 227 | 1626-1646 | AUUGACUUUGAACACAUGUUGCU | 881 | 1624-1646 |
| AD-1727709 | AACAUGUGUUCAAAGUCAAGU | 228 | 1627-1647 | ACUUGACUUUGAACACAUGUUGC | 621 | 1625-1647 |
| AD-1727710 | ACAUGUGUUCAAAGUCAAGGU | 229 | 1628-1648 | ACCUUGACUUUGAACACAUGUUG | 882 | 1626-1648 |
| AD-1727712 | AUGUGUUCAAAGUCAAGGAUU | 230 | 1630-1650 | AAUCCUUGACUUUGAACACAUGU | 883 | 1628-1650 |

TABLE 2-continued

Unmodified Sense and Antisense Strand Sequences of Complement Factor B dsRNA Agents

| Duplex Name | Sense Strand Sequence 5' to 3' | SEQ ID NO: | Range in NM_001710.6 | Antisense Strand Sequence 5' to 3' | SEQ ID NO: | Range in NM_001710.6 |
|---|---|---|---|---|---|---|
| AD-1727713 | UGUGUUCAAAGUCAAGGAUAU | 231 | 1631-1651 | AUAUCCUUGACUUUGAACACAUG | 884 | 1629-1651 |
| AD-1727714 | GUGUUCAAAGUCAAGGAUAUU | 232 | 1632-1652 | AAUAUCCUUGACUUUGAACACAU | 885 | 1630-1652 |
| AD-1727717 | UUCAAAGUCAAGGAUAUGGAU | 233 | 1635-1655 | AUCCAUAUCCUUGACUUUGAACA | 886 | 1633-1655 |
| AD-1727718 | UCAAAGUCAAGGAUAUGGAAU | 234 | 1636-1656 | AUUCCAUAUCCUUGACUUUGAAC | 887 | 1634-1656 |
| AD-1727821 | UACCGAUUACCACAAGCAACU | 244 | 1739-1759 | AGUUGCUUGUGGUAAUCGGUACC | 888 | 1737-1759 |
| AD-1727823 | CCGAUUACCACAAGCAACCAU | 245 | 1741-1761 | AUGGUUGCUUGUGGUAAUCGGUA | 889 | 1739-1761 |
| AD-1727826 | AUUACCACAAGCAACCAUGGU | 247 | 1744-1764 | ACCAUGGUUGCUUGUGGUAAUCG | 890 | 1742-1764 |
| AD-1727829 | ACCACAAGCAACCAUGGCAGU | 250 | 1747-1767 | ACUGCCAUGGUUGCUUGUGGUAA | 891 | 1745-1767 |
| AD-1727883 | UGGUGUCUGAGUACUUUGUGU | 259 | 1822-1842 | ACACAAAGUACUCAGACACCACA | 892 | 1820-1842 |
| AD-1727977 | GAAGCAGGAAUUCCUGAAUUU | 263 | 1974-1994 | AAAUUCAGGAAUUCCUGCUUCUU | 893 | 1972-1994 |
| AD-1727978 | AAGCAGGAAUUCCUGAAUUUU | 264 | 1975-1995 | AAAAUUCAGGAAUUCCUGCUUCU | 894 | 1973-1995 |
| AD-1727980 | GCAGGAAUUCCUGAAUUUUAU | 265 | 1977-1997 | AUAAAAUUCAGGAAUUCCUGCUU | 895 | 1975-1997 |
| AD-1727981 | CAGGAAUUCCUGAAUUUUAUU | 266 | 1978-1998 | AAUAAAAUUCAGGAAUUCCUGCU | 659 | 1976-1998 |
| AD-1727984 | GAAUUCCUGAAUUUUAUGACU | 269 | 1981-2001 | AGUCAUAAAAUUCAGGAAUUCCU | 896 | 1979-2001 |
| AD-1727985 | AAUUCCUGAAUUUUAUGACUU | 270 | 1982-2002 | AAGUCAUAAAAUUCAGGAAUUCC | 897 | 1980-2002 |
| AD-1727986 | AUUCCUGAAUUUUAUGACUAU | 271 | 1983-2003 | AUAGUCAUAAAAUUCAGGAAUUC | 898 | 1981-2003 |
| AD-1727987 | UUCCUGAAUUUUAUGACUAUU | 272 | 1984-2004 | AAUAGUCAUAAAAUUCAGGAAUU | 665 | 1982-2004 |
| AD-1727989 | CCUGAAUUUUAUGACUAUGAU | 274 | 1986-2006 | AUCAUAGUCAUAAAAUUCAGGAA | 899 | 1984-2006 |
| AD-1727990 | CUGAAUUUUAUGACUAUGACU | 275 | 1987-2007 | AGUCAUAGUCAUAAAAUUCAGGA | 900 | 1985-2007 |
| AD-1727992 | GAAUUUUAUGACUAUGACGUU | 276 | 1989-2009 | AACGUCAUAGUCAUAAAAUUCAG | 901 | 1987-2009 |
| AD-1727993 | AAUUUUAUGACUAUGACGUUU | 277 | 1990-2010 | AAACGUCAUAGUCAUAAAAUUCA | 902 | 1988-2010 |
| AD-1727994 | AUUUUAUGACUAUGACGUUGU | 278 | 1991-2011 | ACAACGUCAUAGUCAUAAAAUUC | 903 | 1989-2011 |
| AD-1727996 | UUUAUGACUAUGACGUUGCCU | 279 | 1993-2013 | AGGCAACGUCAUAGUCAUAAAAU | 904 | 1991-2013 |
| AD-1727999 | AUGACUAUGACGUUGCCCUGU | 282 | 1996-2016 | ACAGGGCAACGUCAUAGUCAUAA | 905 | 1994-2016 |
| AD-1728049 | CAGACUAUCAGGCCCAUUUGU | 291 | 2046-2066 | ACAAAUGGGCCUGAUAGUCUGGC | 906 | 2044-2066 |
| AD-1728050 | AGACUAUCAGGCCCAUUUGUU | 292 | 2047-2067 | AACAAAUGGGCCUGAUAGUCUGG | 907 | 2045-2067 |
| AD-1728061 | CGAGGGAACAACUCGAGCUUU | 296 | 2078-2098 | AAAGCUCGAGUUGUUCCCUCGGU | 908 | 2076-2098 |
| AD-1728062 | GAGGGAACAACUCGAGCUUUU | 297 | 2079-2099 | AAAAGCUCGAGUUGUUCCCUCGG | 909 | 2077-2099 |
| AD-1728067 | AACAACUCGAGCUUUGAGGCU | 300 | 2084-2104 | AGCCUCAAAGCUCGAGUUGUUCC | 910 | 2082-2104 |
| AD-1728085 | GCUUCCUCCAACUACCACUUU | 311 | 2102-2122 | AAAGUGGUAGUUGGAGGAAGCCU | 911 | 2100-2122 |
| AD-1728132 | CUGCACAGGAUAUCAAAGCUU | 319 | 2149-2169 | AAGCUUUGAUAUCCUGUGCAGGG | 912 | 2147-2169 |
| AD-1728137 | CAGGAUAUCAAAGCUCUGUUU | 320 | 2154-2174 | AAACAGAGCUUUGAUAUCCUGUG | 913 | 2152-2174 |
| AD-1728140 | GAUAUCAAAGCUCUGUUUGUU | 321 | 2157-2177 | AACAAACAGAGCUUUGAUAUCCU | 714 | 2155-2177 |
| AD-1728146 | AAAGCUCUGUUUGUGUCUGAU | 322 | 2163-2183 | AUCAGACACAAACAGAGCUUUGA | 914 | 2161-2183 |
| AD-1728195 | AAGAAAGGCAGCUGUGAGAGU | 330 | 2232-2252 | ACUCUCACAGCUGCCUUUCUUAU | 915 | 2230-2252 |
| AD-1728204 | AGCUGUGAGAGAUGCUCAU | 332 | 2241-2261 | AUGAGCAUCUCUCUCACAGCUGC | 916 | 2239-2261 |
| AD-1728206 | CUGUGAGAGAGAUGCUCAAUU | 333 | 2243-2263 | AAUUGAGCAUCUCUCUCACAGCU | 917 | 2241-2263 |

TABLE 2-continued

Unmodified Sense and Antisense Strand Sequences of Complement Factor B dsRNA Agents

| Duplex Name | Sense Strand Sequence 5' to 3' | SEQ ID NO: | Range in NM_001710.6 | Antisense Strand Sequence 5' to 3' | SEQ ID NO: | Range in NM_001710.6 |
|---|---|---|---|---|---|---|
| AD-1728207 | UGUGAGAGAGAUGCUCAAUAU | 334 | 2244-2264 | AUAUUGAGCAUCUCUCUCACAGC | 918 | 2242-2264 |
| AD-1728208 | GUGAGAGAGAUGCUCAAUAUU | 335 | 2245-2265 | AAUAUUGAGCAUCUCUCUCACAG | 919 | 2243-2265 |
| AD-1728209 | UGAGAGAGAUGCUCAAUAUGU | 336 | 2246-2266 | ACAUAUUGAGCAUCUCUCUCACA | 920 | 2244-2266 |
| AD-1728210 | GAGAGAGAUGCUCAAUAUGCU | 337 | 2247-2267 | AGCAUAUUGAGCAUCUCUCUCAC | 921 | 2245-2267 |
| AD-1728212 | CAGGCUAUGACAAAGUCAAGU | 338 | 2269-2289 | ACUUGACUUUGUCAUAGCCUGGG | 922 | 2267-2289 |
| AD-1728214 | GGCUAUGACAAAGUCAAGGAU | 340 | 2271-2291 | AUCCUUGACUUUGUCAUAGCCUG | 923 | 2269-2291 |
| AD-1728220 | GACAAAGUCAAGGACAUCUCU | 341 | 2277-2297 | AGAGAUGUCCUUGACUUUGUCAU | 924 | 2275-2297 |
| AD-1728244 | UUGUACUGGAGGAGUGAGUCU | 347 | 2321-2341 | AGACUCACUCCUCCAGUACAAAG | 925 | 2319-2341 |
| AD-1728258 | AAUACUUGCAGAGGUGAUUCU | 356 | 2355-2375 | AGAAUCACCUCUGCAAGUAUUGG | 926 | 2353-2375 |
| AD-1728260 | UACUUGCAGAGGUGAUUCUGU | 357 | 2357-2377 | ACAGAAUCACCUCUGCAAGUAUU | 927 | 2355-2377 |
| AD-1728269 | UGAUAGUUCACAAGAGAAGUU | 360 | 2386-2406 | AACUUCUCUUGUGAACUAUCAAG | 928 | 2384-2406 |
| AD-1728270 | GAUAGUUCACAAGAGAAGUCU | 361 | 2387-2407 | AGACUUCUCUUGUGAACUAUCAA | 929 | 2385-2407 |
| AD-1728271 | AUAGUUCACAAGAGAAGUCGU | 362 | 2388-2408 | ACGACUUCUCUUGUGAACUAUCA | 930 | 2386-2408 |
| AD-1728272 | UAGUUCACAAGAGAAGUCGUU | 363 | 2389-2409 | AACGACUUCUCUUGUGAACUAUC | 931 | 2387-2409 |
| AD-1728273 | AGUUCACAAGAGAAGUCGUUU | 364 | 2390-2410 | AAACGACUUCUCUUGUGAACUAU | 757 | 2388-2410 |
| AD-1728274 | GUUCACAAGAGAAGUCGUUUU | 365 | 2391-2411 | AAAACGACUUCUCUUGUGAACUA | 932 | 2389-2411 |
| AD-1728275 | UUCACAAGAGAAGUCGUUUCU | 366 | 2392-2412 | AGAAACGACUUCUCUUGUGAACU | 759 | 2390-2412 |
| AD-1728276 | UCACAAGAGAAGUCGUUUCAU | 367 | 2393-2413 | AUGAAACGACUUCUCUUGUGAAC | 933 | 2391-2413 |
| AD-1728277 | CACAAGAGAAGUCGUUUCAUU | 368 | 2394-2414 | AAUGAAACGACUUCUCUUGUGAA | 934 | 2392-2414 |
| AD-1728278 | ACAAGAGAAGUCGUUUCAUUU | 369 | 2395-2415 | AAAUGAAACGACUUCUCUUGUGA | 762 | 2393-2415 |
| AD-1728279 | CAAGAGAAGUCGUUUCAUUCU | 370 | 2396-2416 | AGAAUGAAACGACUUCUCUUGUG | 935 | 2394-2416 |
| AD-1728280 | AAGAGAAGUCGUUUCAUUCAU | 371 | 2397-2417 | AUGAAUGAAACGACUUCUCUUGU | 936 | 2395-2417 |
| AD-1728282 | GAGAAGUCGUUUCAUUCAAGU | 373 | 2399-2419 | ACUUGAAUGAAACGACUUCUCUU | 766 | 2397-2419 |
| AD-1728283 | AGAAGUCGUUUCAUUCAAGUU | 374 | 2400-2420 | AACUUGAAUGAAACGACUUCUCU | 937 | 2398-2420 |
| AD-1728284 | GAAGUCGUUUCAUUCAAGUUU | 375 | 2401-2421 | AAACUUGAAUGAAACGACUUCUC | 938 | 2399-2421 |
| AD-1728285 | AAGUCGUUUCAUUCAAGUUGU | 376 | 2402-2422 | ACAACUUGAAUGAAACGACUUCU | 939 | 2400-2422 |
| AD-1728286 | AGUCGUUUCAUUCAAGUUGGU | 377 | 2403-2423 | ACCAACUUGAAUGAAACGACUUC | 940 | 2401-2423 |
| AD-1728300 | GAGUAGUGGAUGUCUGCAAAU | 378 | 2437-2457 | AUUUGCAGACAUCCACUACUCCC | 941 | 2435-2457 |
| AD-1728301 | AGUAGUGGAUGUCUGCAAAAU | 379 | 2438-2458 | AUUUUGCAGACAUCCACUACUCC | 942 | 2436-2458 |
| AD-1728302 | GUAGUGGAUGUCUGCAAAAAU | 380 | 2439-2459 | AUUUUUGCAGACAUCCACUACUC | 943 | 2437-2459 |
| AD-1728303 | UAGUGGAUGUCUGCAAAAACU | 381 | 2440-2460 | AGUUUUUGCAGACAUCCACUACU | 944 | 2438-2460 |
| AD-1728307 | GGAUGUCUGCAAAAACCAGAU | 385 | 2444-2464 | AUCUGGUUUUUGCAGACAUCCAC | 945 | 2442-2464 |
| AD-1728308 | GAUGUCUGCAAAAACCAGAAU | 386 | 2445-2465 | AUUCUGGUUUUUGCAGACAUCCA | 946 | 2443-2465 |
| AD-1728311 | GUCUGCAAAAACCAGAAGCGU | 387 | 2448-2468 | ACGCUUCUGGUUUUUGCAGACAU | 947 | 2446-2468 |
| AD-1728312 | UCUGCAAAAACCAGAAGCGGU | 388 | 2449-2469 | ACCGCUUCUGGUUUUUGCAGACA | 948 | 2447-2469 |
| AD-1728317 | AAAAACCAGAAGCGGCAAAAU | 391 | 2454-2474 | AUUUUGCCGCUUCUGGUUUUUGC | 949 | 2452-2474 |
| AD-1728318 | AAAACCAGAAGCGGCAAAAGU | 392 | 2455-2475 | ACUUUUGCCGCUUCUGGUUUUUG | 950 | 2453-2475 |

TABLE 2-continued

Unmodified Sense and Antisense Strand Sequences of Complement Factor B dsRNA Agents

| Duplex Name | Sense Strand Sequence 5' to 3' | SEQ ID NO: | Range in NM_001710.6 | Antisense Strand Sequence 5' to 3' | SEQ ID NO: | Range in NM_001710.6 |
|---|---|---|---|---|---|---|
| AD-1728320 | AACCAGAAGCGGCAAAAGCAU | 394 | 2457-2477 | AUGCUUUUGCCGCUUCUGGUUUU | 951 | 2455-2477 |
| AD-1728324 | AGAAGCGGCAAAAGCAGGUAU | 395 | 2461-2481 | AUACCUGCUUUUGCCGCUUCUGG | 952 | 2459-2481 |
| AD-1728405 | AACUCCAAGAUGAGGAUUUGU | 399 | 2542-2562 | ACAAAUCCUCAUCUUGGAGUUUC | 953 | 2540-2562 |
| AD-1728408 | UCCAAGAUGAGGAUUUGGGUU | 400 | 2545-2565 | AACCCAAAUCCUCAUCUUGGAGU | 954 | 2543-2565 |
| AD-1728410 | CAAGAUGAGGAUUUGGGUUUU | 401 | 2547-2567 | AAAACCCAAAUCCUCAUCUUGGA | 794 | 2545-2567 |
| AD-1728412 | AGAUGAGGAUUUGGGUUUUCU | 402 | 2549-2569 | AGAAAACCCAAAUCCUCAUCUUG | 795 | 2547-2569 |
| AD-1728422 | GUGGGAUUGAAUUAAAACAGU | 403 | 2597-2617 | ACUGUUUUAAUUCAAUCCCACGC | 955 | 2595-2617 |
| AD-1728423 | UGGGAUUGAAUUAAAACAGCU | 404 | 2598-2618 | AGCUGUUUUAAUUCAAUCCCACG | 956 | 2596-2618 |
| AD-1728424 | GGGAUUGAAUUAAAACAGCUU | 405 | 2599-2619 | AAGCUGUUUUAAUUCAAUCCCAC | 957 | 2597-2619 |
| AD-1728427 | AUUGAAUUAAAACAGCUGCGU | 406 | 2602-2622 | ACGCAGCUGUUUUAAUUCAAUCC | 958 | 2600-2622 |
| AD-1728447 | AAGGGAAUGUGACCAGGUCUU | 19 | 155-175 | AAGACCTGGUCACAUUCCCUUCC | 412 | 153-175 |
| AD-1728461 | AGGUCUAGGUCUGGAGUUUCU | 25 | 169-189 | AGAAACTCCAGACCUAGACCUGG | 418 | 167-189 |
| AD-1728470 | UCUGGAGUUUCAGCUUGGACU | 27 | 178-198 | AGUCCAAGCUGAAACUCCAGACC | 420 | 176-198 |
| AD-1728471 | CUGGAGUUUCAGCUUGGACAU | 28 | 179-199 | AUGUCCAAGCUGAAACUCCAGAC | 959 | 177-199 |
| AD-1728659 | UCCUUCUGGCUUCUACCCGUU | 31 | 464-484 | AACGGGUAGAAGCCAGAAGGACA | 424 | 462-484 |
| AD-1728664 | CUGGCUUCUACCCGUACCCUU | 34 | 469-489 | AAGGGUACGGGUAGAAGCCAGAA | 803 | 467-489 |
| AD-1728671 | CUACCCGUACCCUGUGCAGAU | 35 | 476-496 | AUCUGCACAGGGUACGGGUAGAA | 960 | 474-496 |
| AD-1728685 | UGCAGACACGUACCUGCAGAU | 36 | 490-510 | AUCUGCAGGUACGUGUCUGCACA | 961 | 488-510 |
| AD-1728736 | AAGGCAGAGUGCAGAGCAAUU | 37 | 561-581 | AAUUGCUCUGCACUCUGCCUUCC | 430 | 559-581 |
| AD-1728777 | CCUACUACAAUGUGAGUGAUU | 41 | 634-654 | AAUCACUCACAUUGUAGUAGGGA | 962 | 632-654 |
| AD-1728784 | CAAUGUGAGUGAUGAGAUCUU | 45 | 641-661 | AAGAUCUCAUCACUCACAUUGUA | 438 | 639-661 |
| AD-1728786 | AUGUGAGUGAUGAGAUCUCUU | 47 | 643-663 | AAGAGAUCUCAUCACUCACAUUG | 963 | 641-663 |
| AD-1728787 | UGUGAGUGAUGAGAUCUCUUU | 48 | 644-664 | AAAGAGAUCUCAUCACUCACAUU | 441 | 642-664 |
| AD-1728789 | UGAGUGAUGAGAUCUCUUUCU | 50 | 646-666 | AGAAAGAGAUCUCAUCACUCACA | 808 | 644-666 |
| AD-1728793 | UGAUGAGAUCUCUUUCCACUU | 54 | 650-670 | AAGUGGAAAGAGAUCUCAUCACU | 447 | 648-670 |
| AD-1728801 | UCUCUUUCCACUGCUAUGACU | 57 | 658-678 | AGUCAUAGCAGUGGAAAGAGAUC | 810 | 656-678 |
| AD-1728802 | CUCUUUCCACUGCUAUGACGU | 58 | 659-679 | ACGUCAUAGCAGUGGAAAGAGAU | 451 | 657-679 |
| AD-1728810 | ACUGCUAUGACGGUUACACUU | 60 | 667-687 | AAGUGUAACCGUCAUAGCAGUGG | 811 | 665-687 |
| AD-1728811 | CUGCUAUGACGGUUACACUCU | 61 | 668-688 | AGAGTGTAACCGUCAUAGCAGUG | 454 | 666-688 |
| AD-1728827 | UCGCACCUGCCAAGUGAAUGU | 65 | 704-724 | ACAUTCACUUGGCAGGUGCGAUU | 458 | 702-724 |
| AD-1728861 | CAGACAGCGAUCUGUGACAAU | 67 | 738-758 | AUUGUCACAGAUCGCUGUCUGCC | 964 | 736-758 |
| AD-1728863 | GACAGCGAUCUGUGACAACGU | 69 | 740-760 | ACGUGTUCACAGAUCGCUGUCUG | 462 | 738-760 |
| AD-1728877 | UGGCACAAGGAAGGUGGGCAU | 73 | 794-814 | AUGCCCACCUUCCUUGUGCCAAU | 965 | 792-814 |
| AD-1728909 | UUGAAGACAGCGUCACCUACU | 76 | 826-846 | AGUAGGUGACGCUGUCUUCAAGG | 469 | 824-846 |
| AD-1728990 | AGACUCCUUCAUGUACGACAU | 85 | 935-955 | AUGUCGUACAUGAAGGAGUCUUG | 966 | 933-955 |
| AD-1728995 | CAAGAGGUGGCCGAAGCUUUU | 87 | 960-980 | AAAAGCUCGGCCACCUCUUGAG | 480 | 958-980 |
| AD-1729031 | GAGACCAUAGAAGGAGUCGAU | 90 | 996-1016 | AUCGACUCCUUCUAUGGUCUCUG | 967 | 994-1016 |

TABLE 2-continued

Unmodified Sense and Antisense Strand Sequences of Complement Factor B dsRNA Agents

| Duplex Name | Sense Strand Sequence 5' to 3' | SEQ ID NO: | Range in NM_001710.6 | Antisense Strand Sequence 5' to 3' | SEQ ID NO: | Range in NM_001710.6 |
|---|---|---|---|---|---|---|
| AD-1729089 | CAGGCUCCAUGAACAUCUACU | 96 | 1075-1095 | AGUAGAUGUUCAUGGAGCCUGAA | 489 | 1073-1095 |
| AD-1729103 | AUCUACCUGGUGCUAGAUGGU | 100 | 1089-1109 | ACCAUCUAGCACCAGGUAGAUGU | 493 | 1087-1109 |
| AD-1729105 | CUACCUGGUGCUAGAUGGAUU | 102 | 1091-1111 | AAUCCAUCUAGCACCAGGUAGAU | 495 | 1089-1111 |
| AD-1729106 | UACCUGGUGCUAGAUGGAUCU | 103 | 1092-1112 | AGAUCCAUCUAGCACCAGGUAGA | 496 | 1090-1112 |
| AD-1729110 | UGGUGCUAGAUGGAUCAGACU | 106 | 1096-1116 | AGUCUGAUCCAUCUAGCACCAGG | 968 | 1094-1116 |
| AD-1729112 | GUGCUAGAUGGAUCAGACAGU | 107 | 1098-1118 | ACUGUCUGAUCCAUCUAGCACCA | 500 | 1096-1118 |
| AD-1729130 | CACAGGAGCCAAAAAGUGUCU | 116 | 1136-1156 | AGACACUUUUUGGCUCCUGUGAA | 509 | 1134-1156 |
| AD-1729132 | CAGGAGCCAAAAAGUGUCUAU | 118 | 1138-1158 | AUAGACACUUUUUGGCUCCUGUG | 969 | 1136-1158 |
| AD-1729134 | GGAGCCAAAAAGUGUCUAGUU | 120 | 1140-1160 | AACUAGACACUUUUUGGCUCCUG | 824 | 1138-1160 |
| AD-1729136 | AGCCAAAAAGUGUCUAGUCAU | 122 | 1142-1162 | AUGACUAGACACUUUUUGGCUCC | 970 | 1140-1162 |
| AD-1729137 | GCCAAAAAGUGUCUAGUCAAU | 123 | 1143-1163 | AUUGACUAGACACUUUUUGGCUC | 971 | 1141-1163 |
| AD-1729139 | CAAAAAGUGUCUAGUCAACUU | 125 | 1145-1165 | AAGUUGACUAGACACUUUUUGGC | 518 | 1143-1165 |
| AD-1729141 | AAAAGUGUCUAGUCAACUUAU | 127 | 1147-1167 | AUAAGUUGACUAGACACUUUUUG | 972 | 1145-1167 |
| AD-1729142 | AAAGUGUCUAGUCAACUUAAU | 128 | 1148-1168 | AUUAAGUUGACUAGACACUUUUU | 973 | 1146-1168 |
| AD-1729151 | AGUCAACUUAAUUGAGAAGGU | 134 | 1157-1177 | ACCUUCUCAAUUAAGUUGACUAG | 974 | 1155-1177 |
| AD-1729180 | AUGGUGUGAAGCCAAGAUAUU | 143 | 1186-1206 | AAUAUCUUGGCUUCACACCAUAA | 975 | 1184-1206 |
| AD-1729207 | AAAAUUUGGGUCAAAGUGUCU | 145 | 1233-1253 | AGACACUUUGACCCAAAUUUUGG | 538 | 1231-1253 |
| AD-1729242 | UAAUGCAGACUGGGUCACGAU | 149 | 1268-1288 | AUCGUGACCCAGUCUGCAUUACU | 976 | 1266-1288 |
| AD-1729269 | AAUGAAAUCAAUUAUGAAGAU | 152 | 1296-1316 | AUCUUCAUAAUUGAUUUCAUUGA | 977 | 1294-1316 |
| AD-1729271 | UGAAAUCAAUUAUGAAGACCU | 153 | 1298-1318 | AGGUCUUCAUAAUUGAUUUCAUU | 546 | 1296-1318 |
| AD-1729274 | AAUCAAUUAUGAAGACCACAU | 154 | 1301-1321 | AUGUGGUCUUCAUAAUUGAUUUC | 978 | 1299-1321 |
| AD-1729277 | CAAUUAUGAAGACCACAAGUU | 157 | 1304-1324 | AACUUGUGGUCUUCAUAAUUGAU | 979 | 1302-1324 |
| AD-1729280 | UUAUGAAGACCACAAGUUGAU | 160 | 1307-1327 | AUCAACUUGUGGUCUUCAUAAUU | 980 | 1305-1327 |
| AD-1729285 | AAGACCACAAGUUGAAGUCAU | 165 | 1312-1332 | AUGACUUCAACUUGUGGUCUUCA | 981 | 1310-1332 |
| AD-1729288 | ACCACAAGUUGAAGUCAGGGU | 167 | 1315-1335 | ACCCUGACUUCAACUUGUGGUCU | 560 | 1313-1335 |
| AD-1729290 | CACAAGUUGAAGUCAGGGACU | 169 | 1317-1337 | AGUCCCUGACUUCAACUUGUGGU | 982 | 1315-1337 |
| AD-1729296 | UUGAAGUCAGGGACUAACACU | 172 | 1323-1343 | AGUGUUAGUCCCUGACUUCAACU | 565 | 1321-1343 |
| AD-1729297 | UGAAGUCAGGGACUAACACCU | 173 | 1324-1344 | AGGUGUUAGUCCCUGACUUCAAC | 566 | 1322-1344 |
| AD-1729300 | AGUCAGGGACUAACACCAAGU | 174 | 1327-1347 | ACUUGGUGUUAGUCCCUGACUUC | 567 | 1325-1347 |
| AD-1729413 | UGAUGGAUUGCACAACAUGGU | 181 | 1442-1462 | ACCAUGUUGUGCAAUCCAUCAGU | 574 | 1440-1462 |
| AD-1729461 | UUGGCAAGGAUCGCAAAAACU | 193 | 1510-1530 | AGUUUUUGCGAUCCUUGCCAAUG | 983 | 1508-1530 |
| AD-1729462 | UGGCAAGGAUCGCAAAAACCU | 194 | 1511-1531 | AGGUUUUUGCGAUCCUUGCCAAU | 587 | 1509-1531 |
| AD-1729463 | GGCAAGGAUCGCAAAAACCCU | 195 | 1512-1532 | AGGGUUUUUGCGAUCCUUGCCAA | 588 | 1510-1532 |
| AD-1729487 | GAGGAUUAUCUGGAUGUCUAU | 197 | 1536-1556 | AUAGACAUCCAGAUAAUCCUCCC | 861 | 1534-1556 |
| AD-1729514 | CCAAGUGAACAUCAAUGCUUU | 209 | 1583-1603 | AAAGCAUUGAUGUUCACUUGGUU | 602 | 1581-1603 |
| AD-1729515 | CAAGUGAACAUCAAUGCUUUU | 210 | 1584-1604 | AAAAGCAUUGAUGUUCACUUGGU | 868 | 1582-1604 |
| AD-1729524 | AUCAAUGCUUUGGCUUCCAAU | 211 | 1593-1613 | AUUGGAAGCCAAAGCAUUGAUGU | 869 | 1591-1613 |

TABLE 2-continued

Unmodified Sense and Antisense Strand Sequences of Complement Factor B dsRNA Agents

| Duplex Name | Sense Strand Sequence 5' to 3' | SEQ ID NO: | Range in NM_001710.6 | Antisense Strand Sequence 5' to 3' | SEQ ID NO: | Range in NM_001710.6 |
|---|---|---|---|---|---|---|
| AD-1729525 | UCAAUGCUUUGGCUUCCAAGU | 212 | 1594-1614 | ACUUGGAAGCCAAAGCAUUGAUG | 605 | 1592-1614 |
| AD-1729538 | UUCCAAGAAAGACAAUGAGCU | 215 | 1607-1627 | AGCUCAUGUCUUUCUUGGAAGC | 984 | 1605-1627 |
| AD-1729539 | UCCAAGAAAGACAAUGAGCAU | 216 | 1608-1628 | AUGCUCAUUGUCUUUCUUGGAAG | 985 | 1606-1628 |
| AD-1729541 | CAAGAAAGACAAUGAGCAACU | 217 | 1610-1630 | AGUUGCUCAUUGUCUUUCUUGGA | 610 | 1608-1630 |
| AD-1729545 | AAAGACAAUGAGCAACAUGUU | 219 | 1614-1634 | AACAUGUUGCUCAUUGUCUUUCU | 612 | 1612-1634 |
| AD-1729548 | GACAAUGAGCAACAUGUGUUU | 221 | 1617-1637 | AAACACAUGUUGCUCAUUGUCUU | 614 | 1615-1637 |
| AD-1729550 | CAAUGAGCAACAUGUGUUCAU | 223 | 1619-1639 | AUGAACACAUGUUGCUCAUUGUC | 878 | 1617-1639 |
| AD-1729552 | AUGAGCAACAUGUGUUCAAAU | 224 | 1621-1641 | AUUUGAACACAUGUUGCUCAUUG | 879 | 1619-1641 |
| AD-1729555 | AGCAACAUGUGUUCAAAGUCU | 226 | 1624-1644 | AGACUUUGAACACAUGUUGCUCA | 619 | 1622-1644 |
| AD-1729557 | CAACAUGUGUUCAAAGUCAAU | 227 | 1626-1646 | AUUGACUUUGAACACAUGUUGCU | 986 | 1624-1646 |
| AD-1729559 | ACAUGUGUUCAAAGUCAAGGU | 229 | 1628-1648 | ACCUUGACUUUGAACACAUGUUG | 622 | 1626-1648 |
| AD-1729561 | AUGUGUUCAAAGUCAAGGAUU | 230 | 1630-1650 | AAUCCUUGACUUUGAACACAUGU | 987 | 1628-1650 |
| AD-1729562 | UGUGUUCAAAGUCAAGGAUAU | 231 | 1631-1651 | AUAUCCUUGACUUUGAACACAUG | 988 | 1629-1651 |
| AD-1729567 | UCAAAGUCAAGGAUAUGGAAU | 234 | 1636-1656 | AUUCCAUAUCCUUGACUUUGAAC | 989 | 1634-1656 |
| AD-1729568 | CAAAGUCAAGGAUAUGGAAAU | 235 | 1637-1657 | AUUUCCAUAUCCUUGACUUUGAA | 990 | 1635-1657 |
| AD-1729619 | UGAAAGCCAGUCUCUGAGUCU | 236 | 1688-1708 | AGACUCAGAGACUGGCUUUCAUC | 629 | 1686-1708 |
| AD-1729643 | UGGCAUGGUUUGGGAACACAU | 241 | 1712-1732 | AUGUGUUCCCAAACCAUGCCACA | 991 | 1710-1732 |
| AD-1729667 | GGGUACCGAUUACCACAAGCU | 243 | 1736-1756 | AGCUUGUGGUAAUCGGUACCCUU | 636 | 1734-1756 |
| AD-1729670 | UACCGAUUACCACAAGCAACU | 244 | 1739-1759 | AGUUGCUGUGGUAAUCGGUACC | 637 | 1737-1759 |
| AD-1729673 | CGAUUACCACAAGCAACCAUU | 246 | 1742-1762 | AAUGGUUGCUUGUGGUAAUCGGU | 639 | 1740-1762 |
| AD-1729677 | UACCACAAGCAACCAUGGCAU | 249 | 1746-1766 | AUGCCAUGGUUGCUUGUGGUAAU | 992 | 1744-1766 |
| AD-1729688 | ACCAUGGCAGGCCAAGAUCUU | 252 | 1757-1777 | AAGAUCUUGGCCUGCCAUGGUUG | 645 | 1755-1777 |
| AD-1729690 | CAUGGCAGGCCAAGAUCUCAU | 254 | 1759-1779 | AUGAGAUCUUGGCCUGCCAUGGU | 993 | 1757-1779 |
| AD-1729729 | CUGUGGUGUCUGAGUACUUUU | 256 | 1819-1839 | AAAAGUACUCAGACACCACAGCC | 649 | 1817-1839 |
| AD-1729802 | AGCGGGACCUGGAGAUAGAAU | 262 | 1912-1932 | AUUCUAUCUCCAGGUCCCGCUUC | 994 | 1910-1932 |
| AD-1729841 | GAAGCAGGAAUUCCUGAAUUU | 263 | 1974-1994 | AAAUUCAGGAAUUCCUGCUUCUU | 995 | 1972-1994 |
| AD-1729849 | AAUUCCUGAAUUUUAUGACUU | 270 | 1982-2002 | AAGUCAUAAAAUUCAGGAAUUCC | 996 | 1980-2002 |
| AD-1729850 | AUUCCUGAAUUUUAUGACUAU | 271 | 1983-2003 | AUAGUCAUAAAAUUCAGGAAUUC | 997 | 1981-2003 |
| AD-1729852 | UCCUGAAUUUUAUGACUAUGU | 273 | 1985-2005 | ACAUAGUCAUAAAAUUCAGGAAU | 666 | 1983-2005 |
| AD-1729854 | CUGAAUUUUAUGACUAUGACU | 275 | 1987-2007 | AGUCAUAGUCAUAAAAUUCAGGA | 900 | 1985-2007 |
| AD-1729856 | GAAUUUUAUGACUAUGACGUU | 276 | 1989-2009 | AACGUCAUAGUCAUAAAAUUCAG | 669 | 1987-2009 |
| AD-1729861 | UUAUGACUAUGACGUUGCCCU | 280 | 1994-2014 | AGGGCAACGUCAUAGUCAUAAAA | 673 | 1992-2014 |
| AD-1729862 | UAUGACUAUGACGUUGCCCUU | 281 | 1995-2015 | AAGGGCAACGUCAUAGUCAUAAA | 674 | 1993-2015 |
| AD-1729869 | AUGACGUUGCCCUGAUCAAGU | 285 | 2002-2022 | ACUUGAUCAGGGCAACGUCAUAG | 678 | 2000-2022 |
| AD-1729870 | UGACGUUGCCCUGAUCAAGCU | 286 | 2003-2023 | AGCUUGAUCAGGGCAACGUCAUA | 679 | 2001-2023 |
| AD-1729872 | ACGUUGCCCUGAUCAAGCUCU | 288 | 2005-2025 | AGAGCUUGAUCAGGGCAACGUCA | 681 | 2003-2025 |
| AD-1729926 | GAGGGAACAACUCGAGCUUUU | 297 | 2079-2099 | AAAAGCUCGAGUUGUUCCCUCGG | 998 | 2077-2099 |

TABLE 2-continued

Unmodified Sense and Antisense Strand Sequences of Complement Factor B dsRNA Agents

| Duplex Name | Sense Strand Sequence 5' to 3' | SEQ ID NO: | Range in NM_001710.6 | Antisense Strand Sequence 5' to 3' | SEQ ID NO: | Range in NM_001710.6 |
| --- | --- | --- | --- | --- | --- | --- |
| AD-1729933 | CAACUCGAGCUUUGAGGCUUU | 301 | 2086-2106 | AAAGCCTCAAAGCUCGAGUUGUU | 694 | 2084-2106 |
| AD-1729941 | GCUUUGAGGCUUCCUCCAACU | 306 | 2094-2114 | AGUUGGAGGAAGCCUCAAAGCUC | 699 | 2092-2114 |
| AD-1729947 | AGGCUUCCUCCAACUACCACU | 310 | 2100-2120 | AGUGGUAGUUGGAGGAAGCCUCA | 703 | 2098-2120 |
| AD-1729951 | UUCCUCCAACUACCACUUGCU | 312 | 2104-2124 | AGCAAGTGGUAGUUGGAGGAAGC | 705 | 2102-2124 |
| AD-1729992 | CUCCCUGCACAGGAUAUCAAU | 316 | 2145-2165 | AUUGAUAUCCUGUGCAGGGAGCA | 999 | 2143-2165 |
| AD-1729993 | UCCCUGCACAGGAUAUCAAAU | 317 | 2146-2166 | AUUUGAUAUCCUGUGCAGGGAGC | 1000 | 2144-2166 |
| AD-1729994 | CCCUGCACAGGAUAUCAAAGU | 318 | 2147-2167 | ACUUGAUAUCCUGUGCAGGGAG | 711 | 2145-2167 |
| AD-1729996 | CUGCACAGGAUAUCAAAGCUU | 319 | 2149-2169 | AAGCTUTGAUAUCCUGUGCAGGG | 1001 | 2147-2169 |
| AD-1730001 | CAGGAUAUCAAAGCUCUGUUU | 320 | 2154-2174 | AAACAGAGCUUUGAUAUCCUGUG | 913 | 2152-2174 |
| AD-1730042 | GCUGACUCGGAAGGAGGUCUU | 323 | 2195-2215 | AAGACCUCCUUCCGAGUCAGCUU | 716 | 2193-2215 |
| AD-1730048 | UCGGAAGGAGGUCUACAUCAU | 326 | 2201-2221 | AUGAUGUAGACCUCCUUCCGAGU | 1002 | 2199-2221 |
| AD-1730053 | AGGAGGUCUACAUCAAGAAUU | 329 | 2206-2226 | AAUUCUUGAUGUAGACCUCCUUC | 1003 | 2204-2226 |
| AD-1730059 | AAGAAAGGCAGCUGUGAGAGU | 330 | 2232-2252 | ACUCUCACAGCUGCCUUUCUUAU | 1004 | 2230-2252 |
| AD-1730068 | AGCUGUGAGAGAGAUGCUCAU | 332 | 2241-2261 | AUGAGCAUCUCUCUCACAGCUGC | 916 | 2239-2261 |
| AD-1730071 | UGUGAGAGAGAUGCUCAAUAU | 334 | 2244-2264 | AUAUUGAGCAUCUCUCUCACAGC | 1005 | 2242-2264 |
| AD-1730077 | AGGCUAUGACAAAGUCAAGGU | 339 | 2270-2290 | ACCUUGACUUUGUCAUAGCCUGG | 732 | 2268-2290 |
| AD-1730103 | UUCCUUUGUACUGGAGGAGUU | 345 | 2316-2336 | AACUCCUCCAGUACAAAGGAACC | 1006 | 2314-2336 |
| AD-1730108 | UUGUACUGGAGGAGUGAGUCU | 347 | 2321-2341 | AGACUCACUCCUCCAGUACAAAG | 1007 | 2319-2341 |
| AD-1730110 | GUACUGGAGGAGUGAGUCCCU | 349 | 2323-2343 | AGGGACUCACUCCUCCAGUACAA | 742 | 2321-2343 |
| AD-1730112 | ACUGGAGGAGUGAGUCCCUAU | 350 | 2325-2345 | AUAGGGACUCACUCCUCCAGUAC | 1008 | 2323-2345 |
| AD-1730118 | GGAGUGAGUCCCUAUGCUGAU | 353 | 2331-2351 | AUCAGCAUAGGGACUCACUCCUC | 1009 | 2329-2351 |
| AD-1730122 | AAUACUUGCAGAGGUGAUUCU | 356 | 2355-2375 | AGAAUCACCUCUGCAAGUAUUGG | 1010 | 2353-2375 |
| AD-1730133 | UGAUAGUUCACAAGAGAAGUU | 360 | 2386-2406 | AACUUCUCUUGUGAACUAUCAAG | 1011 | 2384-2406 |
| AD-1730143 | CAAGAGAAGUCGUUUCAUUCU | 370 | 2396-2416 | AGAAUGAAACGACUUCUCUUGUG | 763 | 2394-2416 |
| AD-1730164 | GAGUAGUGGAUGUCUGCAAAU | 378 | 2437-2457 | AUUUGCAGACAUCCACUACUCCC | 941 | 2435-2457 |
| AD-1730167 | UAGUGGAUGUCUGCAAAAACU | 381 | 2440-2460 | AGUUTUTGCAGACAUCCACUACU | 774 | 2438-2460 |
| AD-1730168 | AGUGGAUGUCUGCAAAAACCU | 382 | 2441-2461 | AGGUTUTUGCAGACAUCCACUAC | 775 | 2439-2461 |
| AD-1730169 | GUGGAUGUCUGCAAAAACCAU | 383 | 2442-2462 | AUGGTUTUUGCAGACAUCCACUA | 1012 | 2440-2462 |
| AD-1730171 | GGAUGUCUGCAAAAACCAGAU | 385 | 2444-2464 | AUCUGGUUUUGCAGACAUCCAC | 1013 | 2442-2464 |
| AD-1730183 | AAACCAGAAGCGGCAAAAGCU | 393 | 2456-2476 | AGCUUTGCCGCUUCUGGUUUUU | 786 | 2454-2476 |
| AD-1730184 | AACCAGAAGCGGCAAAAGCAU | 394 | 2457-2477 | AUGCUUTUGCCGCUUCUGGUUUU | 1014 | 2455-2477 |
| AD-1730256 | UGGCUGAAGGAGAAACUCCAU | 398 | 2529-2549 | AUGGAGUUUCUCCUUCAGCCAGG | 1015 | 2527-2549 |
| AD-1730287 | UGGGAUUGAAUUAAAACAGCU | 404 | 2598-2618 | AGCUGUUUUAAUUCAAUCCCACG | 1016 | 2596-2618 |
| AD-1730288 | GGGAUUGAAUUAAAACAGCUU | 405 | 2599-2619 | AAGCTGTUUUAAUUCAAUCCCAC | 798 | 2597-2619 |
| AD-1730293 | UGAAUUAAAACAGCUGCGACU | 408 | 2604-2624 | AGUCGCAGCUGUUUUAAUUCAAU | 1017 | 2602-2624 |
| AD-1730476 | AAUUAAAACAGCUGCGACAAU | 410 | 2455-2475 | AUUGUCGCAGCUGUUUUAAUUCA | 1018 | 2453-2475 |

TABLE 2-continued

Unmodified Sense and Antisense Strand Sequences of Complement Factor B dsRNA Agents

| Duplex Name | Sense Strand Sequence 5' to 3' | SEQ ID NO: | Range in NM_001710.6 | Antisense Strand Sequence 5' to 3' | SEQ ID NO: | Range in NM_001710.6 |
|---|---|---|---|---|---|---|
| AD-1730477 | AAUUAAAACAGCUGCGACAAU | 410 | 2455-2475 | AUGUCGCAGCUGUUUUAAUUCA | 1019 | 2453-2475 |
| AD-1730478 | AUUAAAACAGCUGCGACAACU | 411 | 2456-2476 | AGUUGUCGCAGCUGUUUUAAUUC | 1020 | 2454-2476 |

TABLE 3

Modified Sense and Antisense Strand Sequences of Complement Factor B dsRNA Agents

| Duplex Name | Sense Strand Sequence 5' to 3' | SEQ ID NO: | Antisense Strand Sequence 5' to 3' | SEQ ID NO: | mRNA target sequence | SEQ ID NO: |
|---|---|---|---|---|---|---|
| AD-1724362 | asasgggaauGfUfGfaccaggucuuL96 | 1021 | asdAsgadCcdTggucdAcAfuucccuuscsc | 1672 | GGAAGGGAAUGUGACCAGGUCUA | 2385 |
| AD-1724363 | asggggaaugUfGfAfccaggucuauL96 | 1022 | asdTsagdAcdCuggudCacTfauucccusuc | 1673 | GAAGGGAAUGUGACCAGGUCUAG | 2386 |
| AD-1724364 | gsggaaugugUfAfCfcaggucuaguL96 | 1023 | asdCsuadGadCcuggdTcAfcauuccsusu | 1674 | AAGGGAAUGUGACCAGGUCUAGG | 2387 |
| AD-1724365 | gsgaaugugaAfCfCfaggucuaggsuL96 | 1024 | asdCscudAgdAccugdGuTfacauuccscsu | 1675 | AGGGAAUGUGACCAGGUCUAGGU | 2388 |
| AD-1724369 | usgsugaccaGfGfUfcuaggucuguL96 | 1025 | asdCsagdAcdCuagadCcUfggucacasusu | 1676 | AAUGUGACCAGGUCUAGGUCUGG | 2389 |
| AD-1724370 | gsusgaccagGfUfCfuaggucugguL96 | 1026 | asdCscadGadCcuagdAcCfuggucacsasu | 1677 | AUGUGACCAGGUCUAGGUCUGGA | 2390 |
| AD-1724376 | asgsgucuagGfUfCfuggaguuucuL96 | 1027 | asdGsaadAcdTccagdAcCfuagaccusgsg | 1678 | CCAGGUCUAGGUCUGGAGUUUCA | 2391 |
| AD-1724384 | gsuscuggagUfUfUfcagcuuggauL96 | 1028 | asdTsccdAadGcugadAaCfuccagaccscsu | 1679 | AGGUCUGGAGUUUCAGCUUGGAC | 2392 |
| AD-1724385 | uscsuggaguUfUfCfagcuuggacuL96 | 1029 | asdGsucdCadAgcugdAaAfcuccagascsc | 1680 | GGUCUGGAGUUUCAGCUUGGACA | 2393 |
| AD-1724386 | csusggaguuUfCfAfgcuuggacauL96 | 1030 | asdTsgudCcdAagcudGaAfacuccagsasc | 1681 | GUCUGGAGUUUCAGCUUGGACAC | 2394 |
| AD-1724530 | uscscuuccgAfCfUfucucccaagaL96 | 1031 | asdTscudTgdGagaadGuTfggaggasgsc | 1682 | GCUCCUUCCGACUCUCCAAGAG | 2395 |
| AD-1724572 | usgsuccuucUfGfGfcuucuacccgL96 | 1032 | asdGsggdTadGaagcdCaGfaaggacascsa | 1683 | UGUGUCCUUCUGGCUUCUACCCG | 2396 |
| AD-1724574 | uscsuucuggGfCfUfucuacccguaL96 | 1033 | asdAscgdGgdTagaadGcCfagaaggascsa | 1684 | UGUCCUUCUGGCUUCUACCCGUA | 2397 |
| AD-1724575 | cscsuucuggCfUfUfcuacccguaL96 | 1034 | asdTsacdGgdGuagadAgCfcagaaggssac | 1685 | GUCCUUCUGGCUUCUACCCGUAC | 2398 |
| AD-1724576 | csuscucuggCfUfUfcuaccguacuL96 | 1035 | asdGsuadCgdGguagdAaGfccagaagsgsa | 1686 | UCCUUCUGGCUUCUACCCGUACC | 2399 |
| AD-1724579 | csusggcuucUfAfCfccguaccculL96 | 1036 | asdAsggdGudAcgggdTagFfaagcagsasa | 1687 | UUCUGGCUUCUACCCGUACCCUG | 2400 |
| AD-1724586 | csusacccguAfCfCfcuguggcagaL96 | 1037 | asdTscudGcdAcaggdGuAfcgguagsasa | 1688 | UUCUACCCGUACCCUGUGCAGAC | 2401 |
| AD-1724600 | usgsucagacaCfGfUfaccugcagauL96 | 1038 | asdTscudGcdAgguadCgUfgucugcascsa | 1689 | UGUGCAGACACCGUACCUGCAGAU | 2402 |
| AD-1724651 | asasggcagaGfUfGfcaagcaauuL96 | 1039 | asdAsuudGcdTcugcdAcUfcugcuuscsc | 1690 | GGAAGGCAGAGUGCAGAGCAAUC | 2403 |
| AD-1724653 | gsgscagaguGfCfAfgagcaauccuL96 | 1040 | asdGsgadTudGcucudGcAfcucugccsusu | 1691 | AAGGCAGAGUGCAGAGCAAUCCA | 2404 |
| AD-1724685 | csgsggucuccCfCfUfacuacaauguL96 | 1041 | asdAscadTudGuagudAgFfgagaccgsg | 1692 | CCCGGUCUCCCUACUACAAUGUG | 2405 |
| AD-1724691 | cscscuacuaCfAfAfugugagugauL96 | 1042 | asdTscadCudCacaudTgUfaguaggsasg | 1693 | CUCCCUACUACAAUGUGAGUGAU | 2406 |
| AD-1724692 | cscscuacuacAfAfUfgugagugaugL96 | 1043 | asdAsucdAcdTcacadTuGfuaguaggsgsa | 1694 | UCCCUACUACAAUGUGAGUGAUG | 2407 |

TABLE 3-continued

Modified Sense and Antisense Strand Sequences of Complement Factor B dsRNA Agents

| Duplex Name | Sense Strand Sequence 5' to 3' | SEQ ID NO: | Antisense Strand Sequence 5' to 3' | SEQ ID NO: | mRNA target sequence | SEQ ID NO: |
|---|---|---|---|---|---|---|
| AD-1724693 | csusacuacaAfUfGfugagugaugus L96 | 1044 | asdCsaudCadCucacdAuUfguaguagsgsg | 1695 | CCCUACUACAAUGUGAGUGAUGA | 2408 |
| AD-1724695 | ascsuacaaugUfGfGfaugaugagaguL96 | 1045 | asdCsucdAudCacucdAcAfuuguagusasg | 1696 | CUACUACAAUGUGAGUGAUGAGA | 2409 |
| AD-1724698 | ascsaaugugAfGfUfgaugagaucuuL96 | 1046 | asdGsaudCudCaucadCuCfacauugusasg | 1697 | CUACAAUGUGAGUGAUGAGAUCU | 2410 |
| AD-1724699 | csasaugugaGfUfGfaugagaucucuL96 | 1047 | asdAsgadTcdTcaucdAcUfcacauugsusa | 1698 | UACAAUGUGAGUGAUGAGAUCUC | 2411 |
| AD-1724700 | asasugugagUfGfAfugagaucucuuL96 | 1048 | asdGsagdAudCucacdCaCfucacauusgsu | 1699 | ACAAUGUGAGUGAUGAGAUCUCU | 2412 |
| AD-1724701 | asusgugaguGfAfUfgagaucucuuuL96 | 1049 | asdAsgadGadTcucadTcAfcucacausugs | 1700 | CAAUGUGAGUGAGAUCUCUU | 2413 |
| AD-1724702 | usgsugaguGfAfUfgagaucucuuuuL96 | 1050 | asdAsagdAgdAucucdAuTfacucacasusu | 1701 | AAUGUGAGUGAUGAGAUCUCUUU | 2414 |
| AD-1724703 | gsusgagugaUfGfAfgaucucuuuucL96 | 1051 | asdAsaadGadGaucudCaUfcacucacsasu | 1702 | AUGUGAGUGAUGAGAUCUCUUUC | 2415 |
| AD-1724704 | usgsagugauGfAfGfaucucuuuucuL96 | 1052 | asdGsaadAgdAgaucdTcAfucacucascsa | 1703 | UGUGAGUGAUGAGAUCUCUUUCC | 2416 |
| AD-1724705 | gsasugugaGfAfGfAfucucuuuuccuL96 | 1053 | asdGsgadAadGagaucdCuCfaucacucsasc | 1704 | GUGAGUGAUGAGAUCUCUUUCCA | 2417 |
| AD-1724706 | asgsugaugaGfAfUfcucuuuuccauL96 | 1054 | asdTsggdAadAgagadTcUfcaucaucscsa | 1705 | UGAGUGAUGAGAUCUCUUUCCAC | 2418 |
| AD-1724707 | gsusgaugagAfUfCfucuuuucaccuL96 | 1055 | asdGsugdGadAagagdAuCfucaucacsusc | 1706 | GAGUGAUGAGAUCUCUUUCCACU | 2419 |
| AD-1724708 | usgsaugagaUfCfCfuucuuuccacuL96 | 1056 | asdAsgudGgdAaagadGaUfcucaucascsu | 1707 | AGUGAUGAGAUCUCUUUCCACUG | 2420 |
| AD-1724714 | gsasucucuuUfCfCfacugcuaugauL96 | 1057 | asdCsaudAgdCagugdGaAfagagausus c | 1708 | GAGAUCUCUUUCCACUGCUAUGA | 2421 |
| AD-1724715 | asuscucuuuCfCfAfcugcuaugacuL96 | 1058 | asdTscadTadGcagudGgAfaagagauscsu | 1709 | AGAUCUCUUUCCACUGCUAUGAC | 2422 |
| AD-1724716 | uscsucuuucCfAfCfugcuaugacguL96 | 1059 | asdGsucdAudAcagcdTgGfaaagagasusc | 1710 | GAUCUCUUUCCACUGCUAUGACG | 2423 |
| AD-1724717 | csusucuuccAfCfUfgcuaugacgguL96 | 1060 | asdCsgudCadTagcadGuGfgaagagsgsau | 1711 | AUCUCUUUCCACUGCUAUGACGG | 2424 |
| AD-1724718 | uscsuuuccaCfUfGfcuaugacgguL96 | 1061 | asdCscgdTcdAuagcdAgUfggaagasgsa | 1712 | UCUCUUUCCACUGCUAUGACGGU | 2425 |
| AD-1724725 | ascsugcuauGfAfCfgguuacacucuL96 | 1062 | asdAsgudGudAaccgdTcAfuagcagusgsg | 1713 | CCACUGCUAUGACGGUUACACUC | 2426 |
| AD-1724726 | csusgcuaugAfCfGfguuacacucuL96 | 1063 | asdGsagdTgdTaaccdGuCfauagcagsug | 1714 | CACUGCUAUGACGGUUACACUCU | 2427 |
| AD-1724730 | usasugacggUfUfAfcacucucgguL96 | 1064 | asdCsggdAgdAgugudAaCfcgucauasgsc | 1715 | GCUAUGACGGUUACACUCUCCGG | 2428 |
| AD-1724731 | asusgacgguUfAfCfacucuccgguL96 | 1065 | asdCscgdGadGagugdTaAfccgucausag | 1716 | CUAUGACGGUUACACUCUCCGGG | 2429 |
| AD-1724741 | asuscgcaccUfGfCfcaagugaauuL96 | 1066 | asdAsuudCadCuuggdCaGfgugcgausug | 1717 | CAAUCGCACCUGCCAAGUGAAUG | 2430 |
| AD-1724742 | uscsgcaccuGfCfCfaagugaaugL96 | 1067 | asdCssaudTcdAcuugdGcAfggugcgasusu | 1718 | AAUCGCACCUGCCAAGUGAAUGG | 2431 |

TABLE 3-continued

Modified Sense and Antisense Strand Sequences of Complement Factor B dsRNA Agents

| Duplex Name | Sense Strand Sequence 5' to 3' | SEQ ID NO: | Antisense Strand Sequence 5' to 3' | SEQ ID NO: | mRNA target sequence | SEQ NO: |
|---|---|---|---|---|---|---|
| AD-1724743 | csgscaccugCfCfAfagugaauguL96 | 1068 | asdCscadTudCacuudGgCfaggugcgsasu | 1719 | AUCGCACCUGCCAAGUGAAUGGC | 2432 |
| AD-1724776 | csaagacagcGfAfUfcugugacaauL96 | 1069 | asdTsugdTcdAcagadTcGfcugucugscsc | 1720 | GGCAGACAGCGAUCUGUGACACAC | 2433 |
| AD-1724777 | asgacagcgAfUfCfugugacaacuL96 | 1070 | asdGsuudGudCacagdAuCfgcugucusgsc | 1721 | GCAGACAGCGAUCUGUGACAACG | 2434 |
| AD-1724778 | gsascagcgaUfCfUfgugacaacgguL96 | 1071 | asdCsgudTgdTcacadGaUfcgcugucusug | 1722 | CAGACAGCGAUCUGUGACAACGG | 2435 |
| AD-1724779 | ascsagcgauCfUfGfugacaacgauL96 | 1072 | asdCscgdTudGucacdAgAfucgcuguscsu | 1723 | AGACAGCGAUCUGUGACAACGGA | 2436 |
| AD-1724780 | csasgcgaucUfGfUfgacaacggauL96 | 1073 | asdTsccdGudTgucadCaGfaucgcugsusc | 1724 | GACAGCGAUCUGUGACAACGGAG | 2437 |
| AD-1724781 | asgsgcgaucuGfUfGfacaacggagL96 | 1074 | asdCsucdCgdTugucdAcAfgaucgcusgsu | 1725 | ACAGCGAUCUGUGACAACGGAGC | 2438 |
| AD-1724792 | usgsgcacaaGfAfAfagguggcauL96 | 1075 | asdTsgcdCgdCcdAccuudCcUfugugccasasu | 1726 | AUUGGCACAAGGAAGGUGGGCAG | 2439 |
| AD-1724819 | cscscggcccugAfAfGfacagcguacL96 | 1076 | asdTsgadCgdCugucdTuCfaaggcggsusa | 1727 | UACCGCCUUGAAGACAGCGUCAC | 2440 |
| AD-1724823 | csusugaagaCfAfGfcgucaccuauL96 | 1077 | asdTsagdGudGadGacgcdTgUfcuucaagsgsc | 1728 | GCCUUGAAGACAGCGUCACCUAC | 2441 |
| AD-1724824 | ususugaagacAfAfGfcgucaccuacL96 | 1078 | asdGsuadGgdTgacgdCdGcUfgucucaasgsg | 1729 | CCUUGAAGACAGCGUCACCUACC | 2442 |
| AD-1724825 | usgsaagacaGfCfGfcucaccuaccuL96 | 1079 | asdGsgudAgdGugacdGcUfgucucaasasg | 1730 | CUUGAAGACAGCGUCACCUACCA | 2443 |
| AD-1724860 | gsusugcaggaAfAfGfggugcucuuuL96 | 1080 | asdAsagdAgdCcaccdTuCfcugacacsgsu | 1731 | ACGUGUCAGGAAGGUGCUCUUG | 2444 |
| AD-1724894 | cscsuuccugCfCfAfagacuccuuuL96 | 1081 | asdAsagdGadGucuudGgCfaggaaggscsu | 1732 | AGCCUUCCUGCCAAGACUCCCUUC | 2445 |
| AD-1724897 | uscscugccaAfGfAfcuccuucauuL96 | 1082 | asdAsugdAadGgaguudCuUfggcaggasasg | 1733 | CUUCCUGCCAAGACUCCCUUCAUG | 2446 |
| AD-1724899 | csusgccaagaCfUfUfccuucauguuL96 | 1083 | asdAscadTgdAaggadGuCfuuggcagsgsa | 1734 | UCCUGCCAAGACUCCCUUCAUGUA | 2447 |
| AD-1724900 | usgsccaagaCfUfCfcuucauguauL96 | 1084 | asdTsacdAudGaaggdAgUfcuuggcasgsg | 1735 | CCUGCCAAGACUCCCUUCAUGUAC | 2448 |
| AD-1724903 | csaagacuccCfUfUfcauguacgauL96 | 1085 | asdTscgdTadCaugadAgGfagucuugsgsc | 1736 | GCCAAGACUCCCUUCAUGUACGAC | 2449 |
| AD-1724904 | asaagacuccCfUfUfcauguacgacuL96 | 1086 | asdGsucdGudAcaugdAaGfgagucuusgsg | 1737 | CCAAGACUCCCUUCAUGUACGACA | 2450 |
| AD-1724905 | asgsgacuccuuCfCfAfuguacgacauL96 | 1087 | asdTsgudCgdTacaudGaAfggagucusug | 1738 | CAAGACUCCCUUCAUGUACGACAC | 2451 |
| AD-1724906 | gsascuccuuCfAfUfguacgacacuL96 | 1088 | asdGsugdTcdGuacadTgAfaggagucususu | 1739 | AAGACUCCCUUCAUGUACGACACC | 2452 |
| AD-1724910 | csaasagagguGfCfCfgaagcuuuuL96 | 1089 | asdAsaadGcdTucggdCcAfccucucugsasg | 1740 | CUCAAGAGGUGCCGAAGCUUUC | 2453 |
| AD-1724919 | gscscgaagcUfUfUfccugucuucL96 | 1090 | asdGsaadGadCaggadAaGfcuuccgcscsa | 1741 | UGGCCGAAGCUUUCCUGUCUUCC | 2454 |
| AD-1724945 | asgsagaccaUfAfGfaaggagucgL96 | 1091 | asdCsgadCudCcuucdTaUfgguucusgsu | 1742 | ACAGAGACCAUAGAAGGAGUCGA | 2455 |

TABLE 3-continued

Modified Sense and Antisense Strand Sequences of Complement Factor B dsRNA Agents

| Duplex Name | Sense Strand Sequence 5' to 3' | SEQ ID NO: | Antisense Strand Sequence 5' to 3' | SEQ ID NO: | mRNA target sequence | SEQ NO: |
|---|---|---|---|---|---|---|
| AD-1724946 | gsaagaccauAfGfAfaggagucgauL96 | 1092 | asdTscgdAcdTccuudCuAfuggucucsusg | 1743 | CAGAGACCAUAGAAGGAGUCGAU | 2456 |
| AD-1724947 | asgsaccauaGfAfAfggagucgauuL96 | 1093 | asdAsucdGadCuccudTcTfaugguucscsu | 1744 | AGAGACCAUAGAAGGAGUCGAUG | 2457 |
| AD-1724948 | gsasccauagAfAfAfggagucgaugcuL96 | 1094 | asdCsaudCgdAcuccdTuCfuauggucsusc | 1745 | GAGACCAUAGAAGGAGUCGAUGC | 2458 |
| AD-1724949 | ascscauagaAfGfGfagucgaugcuL96 | 1095 | asdGscadTedGacucdCuUfcuauggucsu | 1746 | AGACCAUAGAAGGAGUCGAUGCU | 2459 |
| AD-1725000 | cscsuucaggCfUfCfcaugaacacauuL96 | 1096 | asdAsugdTudCauggdAgTfcugaaggsgsu | 1747 | ACCCUUCAGGCUCCAUGAACAUC | 2460 |
| AD-1725003 | uscsaggcucCfAfUfgaacaucuacuL96 | 1097 | asdTsagdAudGuucadTgGfagccugasasg | 1748 | CUUCAGGCUCCAUGAACAUCUAC | 2461 |
| AD-1725004 | csaaggcuccAfUfGfaacaucuacuL96 | 1098 | asdGsuadGadTguucdAuGfgagccugsasa | 1749 | UUCAGGCUCCAUGAACAUCUACC | 2462 |
| AD-1725013 | usgsaacaucUfAfCfcuggugcuauL96 | 1099 | asdTsagdCadCcaggdTaGfauguucasusg | 1750 | CAUGAACAUCACCUGGUGCUAG | 2463 |
| AD-1725015 | asascaucaucCfCfUfggugcuagauguL96 | 1100 | asdTscudAgdCaccadGgTfagauguuscsa | 1751 | UGAACAUCUACCUGGUGCUAGAU | 2464 |
| AD-1725017 | csasucuaccUfGfGfugcuagauguL96 | 1101 | asdCsaudCudAgcacdCaGfguagaugsusu | 1752 | AACAUCUACCUGGUGCUAGAUGG | 2465 |
| AD-1725018 | asusucuaccUfGfGfugcuagaugauL96 | 1102 | asdCsscadTcdTagcadCcAfguagdausug | 1753 | ACAUCUACCUGGUGCUAGAUGGA | 2466 |
| AD-1725019 | uscsuaccugGfUfGfcuagaugauuL96 | 1103 | asdTsccdAudCuagcdCadTcuagdCadTcuagdauAu | 1754 | CAUCUACCUGGUGCUAGAUGGAU | 2467 |
| AD-1725020 | csusuaccuggUfGfCfcuagauggauL96 | 1104 | asdAsucdCadTcuagdCacTfcaggaagsasu | 1755 | AUCUACCUGGUGCUAGAUGGAUC | 2468 |
| AD-1725021 | usasccugguGfCfUfuagauggaucuL96 | 1105 | asdGsaudCcAucuadGcAfccaggauasga | 1756 | UCUACCUGGUGCUAGAUGGAUCA | 2469 |
| AD-1725022 | asccuggugCfUfAfgaugaucauL96 | 1106 | asdTsgadTcdCaucudAgTfaccaggusasg | 1757 | CUACCUGGUGCUAGAUGGAUCAG | 2470 |
| AD-1725023 | cscsuggugcUfAfGfauggaucaguL96 | 1107 | asdCsugdAudCcaucdTaGfcaccaggsusa | 1758 | UACCUGGUGCUAGAUGGAUCAGA | 2471 |
| AD-1725025 | usggsgugcuaGfUfGfgaucagacuL96 | 1108 | asdGsucdTgdAuccadTcTfagccaccasgg | 1759 | CCUGGUGCUAGAUGGAUCAGACA | 2472 |
| AD-1725027 | gsusgcuagaUfGfGfaucagacagacuL96 | 1109 | asdCsugdTcdTgaucdCaUfcuagcacscsa | 1760 | UGGUGCUAGAUGGAUCAGACAGC | 2473 |
| AD-1725028 | usgscuagauGfGfAfucagacagcaL96 | 1110 | asdGscudGudCugaudCcAfucuagcascsc | 1761 | GGUGCUAGAUGGAUCAGACAGCA | 2474 |
| AD-1725033 | gsasuggaucAfGfAfcagcauugguL96 | 1111 | asdCsscadAudGcugudCuGfaucccaucsua | 1762 | UAGAUGGAUCAGACAGCAUUGGG | 2475 |
| AD-1725039 | cssaacuuccAfGfGfagccaaaauL96 | 1112 | asdTsuudTgdGcuccdTgUfgaagungscsu | 1763 | AGCAACUUCCACAGGAGCCAAAAA | 2476 |
| AD-1725040 | asascuucacAfGfGfagccaaaaauL96 | 1113 | asdTsuudTudGgcucdCuGfugaaguusgc | 1764 | GCAACUUCACAGGAGCCAAAAAG | 2477 |
| AD-1725041 | ascsuucacaGfGfAfgccaaaaaguL96 | 1114 | asdCsuudTudTggcudCcUfgugaaguugsug | 1765 | CAACUUCACAGGAGCCAAAAAGU | 2478 |
| AD-1725042 | csusucacagGfAfGfccaaaaaguuL96 | 1115 | asdAscudTudTuggcdTcCfugugaagsusu | 1766 | AACUUCACAGGAGCCAAAAAGUG | 2479 |

TABLE 3-continued

Modified Sense and Antisense Strand Sequences of Complement Factor B dsRNA Agents

| Duplex Name | Sense Strand Sequence 5' to 3' | SEQ ID NO: | Antisense Strand Sequence 5' to 3' | SEQ ID NO: | mRNA target sequence | SEQ ID NO: |
|---|---|---|---|---|---|---|
| AD-1725043 | ususcacaggAfGfCfcaaaaagugguuL96 | 1116 | asdCsacdTudTuuggdCuCfcuguagaasgsu | 1767 | ACUUCACAGGAGCCAAAAAGUGU | 2480 |
| AD-1725044 | uscsacaggaGfCfCfcaaaaagugguuUL96 | 1117 | asdAscadCudTuuugdGcUfccugugasasg | 1768 | CUUCACAGGAGCCAAAAAGUGUC | 2481 |
| AD-1725045 | csascaggagCfCfAfaaaaaguguCuL96 | 1118 | asdGsacdAcdTuuuudGgCfuccugugsasa | 1769 | UUCACAGGAGCCAAAAAGUGUCU | 2482 |
| AD-1725046 | ascsaggagCfAfAfaaaagucuuuL96 | 1119 | asdAsgadCadCuuuudTgGfcuccugusgsa | 1770 | UCACAGGAGCCAAAAAGUGUCUA | 2483 |
| AD-1725047 | csaaggagccAfAfAfaaguucauL96 | 1120 | asdTsagdAcdAcuuudTuGfgcuccugsusg | 1771 | CAGGAGCCAAAAAGUGUCUAG | 2484 |
| AD-1725048 | asggagccaAfAfAfagugucuaguL96 | 1121 | asdCsuadGadCacuudTuUfggcuccusgsu | 1772 | ACAGGAGCCAAAAAGUGUCUAGU | 2485 |
| AD-1725049 | gsggagcccaAfAfAfgugucuagucuL96 | 1122 | asdAscudAgAdAcacudTuUfuggcucscsu | 1773 | CAGGAGCCAAAAAGUGUCUAGUC | 2486 |
| AD-1725050 | gsasgccaaaAfAfGfugucuagucuL96 | 1123 | asdGsacdTadGacacdTuUfuuggcucscsu | 1774 | AGGAGCCAAAAAGUGUCUAGUCA | 2487 |
| AD-1725051 | asgccaaaaAfAfGfugucuagucaUL96 | 1124 | asdTsugdCudAgaacadCuUfuuuugcuscsc | 1775 | GGAGCCAAAAAGUGUCUAGUCAA | 2488 |
| AD-1725052 | gscscaaaaaAfAfGfUfGfucuaguacaUL96 | 1125 | asdTsugdAcdTagacdAcUfuuuugcuscsc | 1776 | GAGCCAAAAAGUGUCUAGUCAAC | 2489 |
| AD-1725053 | cscsaaaaagUfAfGfucuagucaacuL96 | 1126 | asdGsuudGadCuagadCaCfuuuuugscsu | 1777 | AGCCAAAAAGUGUCUAGUCAACU | 2490 |
| AD-1725054 | csaaaaaaguCfAfAfcuagucaacuuL96 | 1127 | asdAsgudTgdAcuagdAcAfcuuuugsgsc | 1778 | GCCAAAAAGUGUCUAGUCAACUU | 2491 |
| AD-1725055 | asaaaagugUfCfUfagucaacuuuL96 | 1128 | asdAsagdTudGacuadGacTfacuuuusgsg | 1779 | CCAAAAAGUGUCUAGUCAACUUA | 2492 |
| AD-1725056 | asaaaaagugCfUfAfgucaacuaaUL96 | 1129 | asdTsaadGudTgacudAgAfcacuuuususg | 1780 | CAAAAAGUGUCUAGUCAACUUAA | 2493 |
| AD-1725057 | asaaagugucUfAfGfucaacuaaUL96 | 1130 | asdTsuadAgdTugacdTadGfacacuuususu | 1781 | AAAAAGUGUCUAGUCAACUUAAU | 2494 |
| AD-1725058 | asasgugucuAfGfUfcaacuaauuUL96 | 1131 | asdAsuudAadGuugadCuAfgacacuususu | 1782 | AAAAGUGUCUAGUCAACUUAAUU | 2495 |
| AD-1725059 | asgugucuaGfUfCfcaacuaauugL96 | 1132 | asdAsaudTadAgaugdAcTfagacacusuus | 1783 | AAAGUGUCUAGUCAACUUAAUUG | 2496 |
| AD-1725060 | gsusgucuagUfCfAfAfacuuaauugaUL96 | 1133 | asdCsaadTudAaguudGaCfuagacacusuu | 1784 | AAGUGUCUAGUCAACUUAAUUGA | 2497 |
| AD-1725061 | usgucuaguCfAfAfCfuuaauugauUL96 | 1134 | asdTscadAudTaaguudTgAfcuagacascsu | 1785 | AGUGUCUAGUCAACUUAAUUGAG | 2498 |
| AD-1725062 | gsuscuagucAfAfCfuuaauugagL96 | 1135 | asdCsucdAadTuaagdTuGfacuagacsasc | 1786 | GUGUCUAGUCAACUUAAUUGAGA | 2499 |
| AD-1725066 | asgucaacuUfAfAfuugagaggUL96 | 1136 | asdCscudTcdTcaaudTaAfguugacusasg | 1787 | CUAGUCAACUUAAUUGAGAAGGU | 2500 |
| AD-1725074 | usaaauugagAfAfGfguggcaagUL96 | 1137 | asdAscudTgdCccacdTuCfucaauuaasag | 1788 | CUUAAUUGAGAAGGUGGCAAGU | 2501 |
| AD-1725075 | asaauugagAfAfGfGfuggcaaguuaL96 | 1138 | asdAsacdTudGccacdCuUfcucaauusasa | 1789 | UUAAUUGAGAAGGUGGCAAGUUA | 2502 |
| AD-1725079 | gsaagaaggUfGfCfaaguuauggU96 | 1139 | asdCsscadTadAcuugdCcAfccuucucsasa | 1790 | UUGAGAGGUGGCAAGUUAUGGU | 2503 |

TABLE 3-continued

Modified Sense and Antisense Strand Sequences of Complement Factor B dsRNA Agents

| Duplex Name | Sense Strand Sequence 5' to 3' | SEQ ID NO: | Antisense Strand Sequence 5' to 3' | SEQ ID NO: | mRNA target sequence | SEQ NO: |
|---|---|---|---|---|---|---|
| AD-1725080 | asgsaaggugGfCfAfaguuauggu uL96 | 1140 | asdAsccdAudAacuudGcfaccuucuscsa | 1791 | UGAGAAGGUGGCAAGUUAUGGUG | 2504 |
| AD-1725082 | asasgguggCfAfAfGfguuaugguguuL96 | 1141 | asdAscadCcdAuaacdTuGfccaccuususu | 1792 | AGAAGGUGGCAAGUUAUGGUGUG | 2505 |
| AD-1725083 | asgsguggcAfAfGfUfuauggugugu ccuL96 | 1142 | asdCsacdAcdCauaadCuUfgccaccusus | 1793 | GAAGGUGGCAAGUUAUGGUGUGA | 2506 |
| AD-1725088 | gscsaaguuaUfGfGfugugaagccuL96 | 1143 | asdGsgcdTudCacacdCaUfaacuugcscsa | 1794 | UGGCAAGUUAUGGUGUGAAGCCA | 2507 |
| AD-1725092 | gsuuauggUfGfUfgfaagcaagauL96 | 1144 | asdTscudTgdGcuucdAcAfccauaacsusu | 1795 | AAGUUAUGGUGUGAAGCCAAGAU | 2508 |
| AD-1725095 | asusgguggAfAfGfccaagauauuL96 | 1145 | asdAsuadTcdTuggcdTuCfacaccausasa | 1796 | UUAUGGUGUGAAGCCAAGAUAUG | 2509 |
| AD-1725096 | usgggugaAfGfCfcaagauaugucL96 | 1146 | asdCsaudAudCuuggdCuUfcacaccustus | 1797 | UAUGGUGUGAAGCCAAGAUAUGG | 2510 |
| AD-1725122 | asasaauuugGfAfGfUfcaaagugucuL96 | 1147 | asdGsacdAcdTuugadCcCfaaauuuusgsg | 1798 | CCAAAAUUUGGGUCAAAGUGUCU | 2511 |
| AD-1725123 | asasauuuugGfUfCfaaagugucuuL96 | 1148 | asdAsgadCadCuuugdActfcaaauuususg | 1799 | CAAAAUUUGGGUCAAAGUGUCUG | 2512 |
| AD-1725125 | asusuugggcUfAfAfaguucugaL96 | 1149 | asdTscadGadCacuudTgAfcccaaausus | 1800 | AAAUUUGGGUCAAAGUGUCUGAA | 2513 |
| AD-1725156 | gsusaaugcAfGfAfCfuggguacgcacuL96 | 1150 | asdCsgudGadCccagdTcUfgcauuacsusg | 1801 | CAGUAAUGCAGACUGGGUCACGA | 2514 |
| AD-1725157 | usasaugcagAfCfUfgggucacgaaL96 | 1151 | asdTscgdTgdAcccagdGuCfugcauuascu | 1802 | AGUAAUGCAGACUGGGUCACGAA | 2515 |
| AD-1725158 | asasaugcagaCfUfGfgggucacgaauL96 | 1152 | asdTsucdGudGacccdAgUfcugcacauasc | 1803 | GUAAUGCAGACUGGGUCACGAAG | 2516 |
| AD-1725159 | asusgcagacUfGfGfgucacgaaguL96 | 1153 | asdCsuudCgdTgaccdCaGfucugcaususa | 1804 | UAAUGCAGACUGGGUCACGAAGC | 2517 |
| AD-1725184 | asasaugaaauCfAfAfuuaugaagacL96 | 1154 | asdTscudTcdAuaaudTgAfuuucauusgsa | 1805 | UCAAUGAAAUCAAUUAUGAAGAC | 2518 |
| AD-1725186 | usgsaaaucaAfUfUfaugaagaccuL96 | 1155 | asdGsgudCudTcauadAuUfgauuucasusu | 1806 | AAUGAAAUCAAUUAUGAAGACCA | 2519 |
| AD-1725189 | asasucaauuAfUfUfgfagaccacaaL96 | 1156 | asdTsgudGgdTcuucdAuAfauugauususc | 1807 | GAAAUCAAUUAUGAAGACCACAA | 2520 |
| AD-1725190 | asuscaauuaUfGfAfagaccacaaguL96 | 1157 | asdTsugdTgdGucuudCaUfaauugausus | 1808 | AAAUCAAUUAUGAAGACCACAAG | 2521 |
| AD-1725191 | uscaauuauGfAfAfgaccacaaguuL96 | 1158 | asdCsuudGudGgucudTcAfuaauugasusu | 1809 | AAUCAAUUAUGAAGACCACAAGU | 2522 |
| AD-1725192 | csasauuaugAfAfgfaccacaaguuuL96 | 1159 | asdAscudTgdTggucdTuCfauaauugasau | 1810 | AUCAAUUAUGAAGACCACAAGUU | 2523 |
| AD-1725193 | asasauuaugaAfGfAfcfcacaaguuL96 | 1160 | asdAsacdTudGuguddCuUfcauaauusgsa | 1811 | UCAAUUAUGAAGACCACAAGUUG | 2524 |
| AD-1725194 | asusuaugaaGfAfCfcacaaguugaL96 | 1161 | asdCsaadCudTguggdTcUfucauaausug | 1812 | CAAUUAUGAAGACCACAAGUUGA | 2525 |
| AD-1725195 | ususaugaagAfCfCfacaaguugauL96 | 1162 | asdTscadAcdTugugdGuCfuucauaasusu | 1813 | AAUUAUGAAGACCACAAGUUGAA | 2526 |
| AD-1725196 | usasugaagaCfCfAfcaaguugaauL96 | 1163 | asdTsucdAadCuugudGfucuucauasasu | 1814 | AUUAUGAAGACCACAAGUUGAAG | 2527 |

TABLE 3-continued

Modified Sense and Antisense Strand Sequences of Complement Factor B dsRNA Agents

| Duplex Name | Sense Strand Sequence 5' to 3' | SEQ ID NO: | Antisense Strand Sequence 5' to 3' | SEQ ID NO: | mRNA target sequence | SEQ ID NO: |
|---|---|---|---|---|---|---|
| AD-1725197 | asusgaagacCfAfCfaaguugaaguL96 | 1164 | asdCsuudCadAcuugdTgGfucuucausasa | 1815 | UUAUGAAGACCACAAGUUGAAGU | 2528 |
| AD-1725198 | usgsaagaccAfCfAfagguugaagucuL96 | 1165 | asdAscudTcdAacucdGuGfgucucusuga | 1816 | UAUGAAGACCACCAAGUUGAAGUC | 2529 |
| AD-1725199 | gsaasagaccAfCfAfguugaagucuL96 | 1166 | asdGsacdTudCaacudTgTfggucuucsasu | 1817 | AUGAAGACCACCAAGUUGAAGUCA | 2530 |
| AD-1725200 | asasgaccacAfAfGfuugaagucauL96 | 1167 | asdTsgadCudTcaacdTuGfuggucuuscsa | 1818 | UGAAGACCACCAAGUUGAAGUCAG | 2531 |
| AD-1725201 | asgsaccacaAfGfUfugaaguccaguL96 | 1168 | asdGsccdTgdAcdTucaadCuTfgugucusuc | 1819 | GAAGACCACCAAGUUGAAGUCAGG | 2532 |
| AD-1725203 | ascscacaagUfGfGfaaguccaggauL96 | 1169 | asdCsccdTgdAcuucdAaCfuugugguscsu | 1820 | AGACCACCAAGUUGAAGUCAGGGA | 2533 |
| AD-1725204 | cscsacaaguUfGfAfaguccaggacuL96 | 1170 | asdTsccdCudGacuudCaAfcuuguggsusc | 1821 | GACCACAAGUUGAAGUCAGGGAC | 2534 |
| AD-1725205 | csascaaguuGfAfAfguccaggacuuL96 | 1171 | asdGsucdCcdTgacudTcAfacuugusgsu | 1822 | ACCACAAGUUGAAGUCAGGGACU | 2535 |
| AD-1725206 | ascsaaguugAfAfAfgucaggacuuL96 | 1172 | asdAsgudCcdCugacdTucfaacuugusgsg | 1823 | CCACAAGUUGAAGUCAGGGACUA | 2536 |
| AD-1725208 | asasguugaaGfUfCfagggacuaauL96 | 1173 | asdTsuadGudCccugdAcUfucaacuusgsu | 1824 | ACAAGUUGAAGUCAGGGACUAAC | 2537 |
| AD-1725211 | ususgaagucAfGfGfgacuaacacuL96 | 1174 | asdGsugdTudAgucdCudGfacuucaasscu | 1825 | AGUUGAAGUCAGGGACUAACACC | 2538 |
| AD-1725212 | usgsaagucaGfGfGfacuaacacuL96 | 1175 | asdGsgudGudTagucdCcUfgacucasasc | 1826 | GUUGAAGUCAGGGACUAACACCA | 2539 |
| AD-1725215 | asgsucaggaGfAfCfUfaaaccaccaaguL96 | 1176 | asdCsuudGgdTguuadGuCfccugacusuc | 1827 | GAAGUCAGGGACUAACACCAAGA | 2540 |
| AD-1725216 | gsuscaggaCfUfAfAfacccaagauL96 | 1177 | asdTscudTgdGuguudAgUfccugacsusu | 1828 | AAGUCAGGGACUAACACCAAGAA | 2541 |
| AD-1725243 | cscsaggcagUfGfUfacagcauguL96 | 1178 | asdTscadTgdCuguadCacTfgacccuggsag | 1829 | CUCCAGGCAGUGUACAGCAUGAU | 2542 |
| AD-1725244 | csasggcaguGfUfAfcagcaugauuL96 | 1179 | asdAsucdAudGcugudAcAfcugccuggsa | 1830 | UCCAGGCAGUGUACAGCAUGAUG | 2543 |
| AD-1725245 | asgsgcagugUfAfCfagcaugaugaL96 | 1180 | asdCsaudCadTgcugdTacTfacugccusgg | 1831 | CCAGGCAGUGUACAGCAUGAUGA | 2544 |
| AD-1725247 | gscsagugcaCfAfGfcaugaugagcL96 | 1181 | asdCsucdAudCaugcdTgUfacacugcscsu | 1832 | AGGCAGUGUACAGCAUGAUGAGC | 2545 |
| AD-1725327 | csusgaugaUfUfGfcaacaugugL96 | 1182 | asdCsaudGudTgucdAaUfccaucagsusc | 1833 | GACUGAUGGAUUGCACAACAUGG | 2546 |
| AD-1725328 | usgsaugauuGfCfCfacaacauggL96 | 1183 | asdCscadTgdTugugdCaAfuccaucasgsu | 1184 | ACUGAUGGAUUGCACAACAUGGG | 2547 |
| AD-1725329 | gsasugauuGfCfAfcaacauggguL96 | 1184 | asdCsccdAudGuugudGcAfauccaucsasg | 1835 | CUGAUGGAUUGCACAACAUGGGC | 2548 |
| AD-1725330 | asusgauugCfAfCfaacaugggcuL96 | 1185 | asdGsccdCadTguugdTgcfaauccausca | 1836 | UGAUGGAUUGCACAACAUGGGCG | 2549 |
| AD-1725331 | usgsgauugCfAfCfAfacaugggcgL96 | 1186 | asdCsgcdCcdAuguudGuGfcaauccasusc | 1837 | GAUGGAUUGCACAACAUGGGCGG | 2550 |
| AD-1725332 | gsgsauugcaCfAfAfcauggggcgL96 | 1187 | asdCscgdCcdCauguudGufgcaauccsasu | 1838 | AUGGAUUGCACAACAUGGGCGGG | 2551 |

TABLE 3-continued

Modified Sense and Antisense Strand Sequences of Complement Factor B dsRNA Agents

| Duplex Name | Sense Strand Sequence 5' to 3' | SEQ ID NO: | Antisense Strand Sequence 5' to 3' | SEQ ID NO: | mRNA target sequence | SEQ NO: |
|---|---|---|---|---|---|---|
| AD-1725333 | gsasccccaauUfAfCfugucauugauL96 | 1188 | asdTscadAudGacagdTaAfuuggucscsc | 1839 | GGGACCCAAUUACUGUCAUUGAU | 2552 |
| AD-1725334 | ascsccaauuAfCfUfgucauugauuL96 | 1189 | asdAsucdAadTgacadGuAfauuggguscsc | 1840 | GGACCCAAUUACUGUCAUUGAUG | 2553 |
| AD-1725336 | cscsaauuacUfGfUfcauugaugauL96 | 1190 | asdTscadTcdAaugadCaGfuaauuggsgsu | 1841 | ACCCAAUUACUGUCAUUGAUGAG | 2554 |
| AD-1725344 | usgsucauugAfUfGfagauccggguL96 | 1191 | asdCsccdGgdAucucdAucAfaaugacasgsu | 1842 | ACUGUCAUUGAUGAGAUCCGGGA | 2555 |
| AD-1725345 | gsuscauugAfUfGfAfgauccggauL96 | 1192 | asdTsccdCgdGaucudCaUfcaaugacsasg | 1843 | CUGUCAUUGAUGAGAUCCGGGAC | 2556 |
| AD-1725347 | csasuugaugAfGfAfuccgggacuuL96 | 1193 | asdAsgudCcdCggaudCuCfaucaaugsasc | 1844 | GUCAUUGAUGAGAUCCGGGACUU | 2557 |
| AD-1725348 | asusugaugaGfAfUfccgggacuuuL96 | 1194 | asdAsagudTcdCcggadTcUfcaucaausgsa | 1845 | UCAUUGAUGAGAUCCGGGACUUG | 2558 |
| AD-1725376 | ususggcaagGfAfUfcgcaaaaacuL96 | 1195 | asdGsuudTudTgcgadTcCfuugccaasusg | 1846 | CAUUGGCAAGGAUCGCAAAAACC | 2559 |
| AD-1725377 | usggcaaggAfUfCfgcaaaaaccuL96 | 1196 | asdGsgudTudTugcgdAuUfcuugccasasu | 1847 | AUUGGCAAGGAUCGCAAAAACCC | 2560 |
| AD-1725378 | gsgscaaggaUfCfGfcaaaaacccuL96 | 1197 | asdGsggdTudTuugcdGaUfccuugccasa | 1848 | UUGGCAAGGAUCGCAAAAACCCA | 2561 |
| AD-1725397 | csaasagggaGfAfUfuaucuggauuL96 | 1198 | asdAsucdCadGauaadTccfuccuugsgsg | 1849 | CCCAAGGGAGGAUUAUCUGGAUG | 2562 |
| AD-1725402 | gsasggauuaUfCfUfggaugucuauL96 | 1199 | asdTsagdAcdAuccadGaUfaaucucscsc | 1850 | GGGAGGAUUAUCUGGAUGUCUAU | 2563 |
| AD-1725403 | asggauuauCfUfGfgaugucuauuL96 | 1200 | asdAsuadGadCauccdAgAfaauccuscsc | 1851 | GGAGGAUUAUCUGGAUGUCUAUG | 2564 |
| AD-1725404 | gsgsauuaucUfGfGfaugucuaugUL96 | 1201 | asdCsaudAgAcaucdCaGfauaauccsusc | 1852 | GAGGAUUAUCUGGAUGUCUAUGU | 2565 |
| AD-1725405 | gsasuuaucuGfGfAfugucuagugUL96 | 1202 | asdAscadTadGacaudCCfAfgauaauscscsu | 1853 | AGGAUUAUCUGGAUGUCUAUGUG | 2566 |
| AD-1725406 | asusuaucugGfAfUfgucuauguguL96 | 1203 | asdCsacdAudAgacadTcCfagauauauscsc | 1854 | GGAUUAUCUGGAUGUCUAUGUGU | 2567 |
| AD-1725407 | ususaucuggAfUfGfucuauguguuL96 | 1204 | asdAscadCadTagacdAuTcfagauaasusc | 1855 | GAUUAUCUGGAUGUCUAUGUGUU | 2568 |
| AD-1725408 | usasucuggaUfGfUfcuauguguuuL96 | 1205 | asdAsacdAcdAuagadCaUfccagauasasu | 1856 | AUUAUCUGGAUGUCUAUGUGUUU | 2569 |
| AD-1725409 | asuscuggauGfUfCfuaugugauuuaL96 | 1206 | asdAsaadCadCauagdAcAfuccagausasa | 1857 | UUAUCUGGAUGUCUAUGUGUUUG | 2570 |
| AD-1725410 | uscsuggaugUfCfUfaugugauuguL96 | 1207 | asdCsaadAcdAcauadGaCfauccagasusa | 1858 | UAUCUGGAUGUCUAUGUGUUUGG | 2571 |
| AD-1725411 | csusggaugucUfUfAfugugauuuguL96 | 1208 | asdCscadAadCacaudAgAfcauccagsasu | 1859 | AUCUGGAUGUCUAUGUGUUUGGG | 2572 |
| AD-1725427 | asasccaaguCfUfAfAfcaucaaugcuL96 | 1209 | asdGscadTudGaugudTcAfcuugguuscsa | 1860 | UGAACCAAGUGAACAUCAAUGCU | 2573 |
| AD-1725428 | ascscaagugAfAfCfaucaaugcuuL96 | 1210 | asdAsgcdAudTgaugdTuCfacuuggusuc | 1861 | GAACCAAGUGAACAUCAAUGCUU | 2574 |
| AD-1725429 | cscsaagugaAfCfAfucaaugcuuuL96 | 1211 | asdAsagcdAdTgaudGuUfcacuuggsusu | 1862 | AACCAAGUGAACAUCAAUGCUUU | 2575 |

TABLE 3-continued

Modified Sense and Antisense Strand Sequences of Complement Factor B dsRNA Agents

| Duplex Name | Sense Strand Sequence 5' to 3' | SEQ ID NO: | Antisense Strand Sequence 5' to 3' | SEQ ID NO: | mRNA target sequence | SEQ ID NO: |
|---|---|---|---|---|---|---|
| AD-1725430 | csaasaguaaCfAfUfcaaugucuuuuL96 | 1212 | asdAsaadGcdAuugadTgUfcacuugsgsu | 1863 | ACCAAGUGAACAUCAAUGCUUUG | 2576 |
| AD-1725439 | asuscaaugcUfUfUfggcuuccaauL96 | 1213 | asdTsugdGadAgccadAaGfcauugausgsu | 1864 | ACAUCAAUGCUUUGGCUUCCAAG | 2577 |
| AD-1725440 | usccaaugcuUfUfgfgcuuccaaguL96 | 1214 | asdCsuudGgdAagccdAaAfgcauugasusg | 1865 | CAUCAAUGCUUUGGCUUCCAAGA | 2578 |
| AD-1725441 | csaaugcuuUfGfGfcuuccaagaUfL96 | 1215 | asdTsculdTgdGaagcdCaAfagcauugsasu | 1866 | AUCAAUGCUUUGGCUUCCAAGAA | 2579 |
| AD-1725449 | usgggcuuccAfAfGfaaagacaauuL96 | 1216 | asdAsuudGudCuuucdTuGfgaagccasasa | 1867 | UUUGGCUUCCAGAAAGACAAUG | 2580 |
| AD-1725453 | ususccaagaAfAfGfaccaaugacuL96 | 1217 | asdGscudCadTugucdTuUfcuuggaasgsc | 1868 | GCUUCCAAGAAAGACAAUGAGCA | 2581 |
| AD-1725454 | usccaagaaAfGfAfcaauggagcauL96 | 1218 | asdTsgcdTcdAuugudCuUfucuuggasasg | 1869 | CUUCCAAGAAAGACAAUGAGCAA | 2582 |
| AD-1725456 | csaasaagaAfCfAfaugagcaacuL96 | 1219 | asdGsuudGcdTcauudGuCfuuuucuugsgsa | 1870 | UCCAAGAAAGACAAUGAGCAACA | 2583 |
| AD-1725457 | asaagagaCfAfAfugagcaacauL96 | 1220 | asdTsgudTgdCucaudTgUfcauucuusgsg | 1871 | CCAAGAAAGACAAUGAGCAACAU | 2584 |
| AD-1725460 | asasagacaaUfGfAfgcaacauguuL96 | 1221 | asdAscadTgdTugucdCaUfugucuuscsu | 1872 | AGAAAGACAAUGAGCAACAUGUG | 2585 |
| AD-1725462 | asgsacaaugAfGfCfaacauguguuL96 | 1222 | asdAscadCadTgugudGcCfaaugucususu | 1873 | AAAGACAAUGAGCAACAUGUGUU | 2586 |
| AD-1725463 | gsascaaugaGfCfAfacauguguuL96 | 1223 | asdAsacadAcdAugugadGcUfcauugucsusu | 1874 | AAGACAAUGAGCAACAUGUGUUC | 2587 |
| AD-1725464 | ascsaaugagCfAfAfcauguuucuL96 | 1224 | asdGsaadCadCaugudTgCfucauuguscsu | 1875 | AGACAAUGAGCAACAUGUGUUCA | 2588 |
| AD-1725465 | csaasaugagaCfAfAfcauguucauL96 | 1225 | asdTsgadAcdAcaugdTuGfcucauugsusc | 1876 | GACAAUGAGCAACAUGUGUUCAA | 2589 |
| AD-1725467 | asusgagcaaCfAfUfguguucaauL96 | 1226 | asdTsuudGadAcacadTgUfugcucausug | 1877 | CAAUGAGCAACAUGUGUUCAAAG | 2590 |
| AD-1725469 | gsasgcaacaUfGfUfguucaaaguuL96 | 1227 | asdAscudTudGaacadCaUfguugcuscsau | 1878 | AUGAGCAACAUGUGUUCAAAGUC | 2591 |
| AD-1725470 | asgscaacauGfUfGfuucaaagucuL96 | 1228 | asdGsacdTudTgaacdAcAfuguugcuscsa | 1879 | UGAGCAACAUGUGUUCAAAGUCA | 2592 |
| AD-1725472 | csaasacauguGfUfUfcaaagucaauL96 | 1229 | asdTsugdAcdTuugadAcAfcauguugcsu | 1880 | AGCAACAUGUGUUCAAAGUCAAG | 2593 |
| AD-1725473 | asascaugugUfUfCfaaagucaaguL96 | 1230 | asdCsuudGadCuuugdAaCfacauguusgsc | 1881 | GCAACAUGUGUUCAAAGUCAAGG | 2594 |
| AD-1725474 | ascsaugugUfCfAfaagucaaggaL96 | 1231 | asdCscudTgdAcuuudGaAfcacauguusg | 1882 | CAACAUGUGUUCAAAGUCAAGGA | 2595 |
| AD-1725476 | asusguguucAfAfAfgucaaggauuL96 | 1232 | asdAsucdCudTgacudTuGfaacacausgsu | 1883 | ACAUGUGUUCAAAGUCAAGGAUA | 2596 |
| AD-1725477 | usgsuguucaAfAfGfucaaggauauL96 | 1233 | asdTsaudCcdTugacdTuUfgaacacasug | 1884 | CAUGUGUUCAAAGUCAAGGAUAU | 2597 |
| AD-1725478 | gsusguucaaAfGfUfcaaggauauuL96 | 1234 | asdAsuadTcdCuugadCuUfugaacacsasu | 1885 | AUGUGUUCAAAGUCAAGGAUAUG | 2598 |
| AD-1725481 | ususcaaagucAfAfGfggauauggauL96 | 1235 | asdTsccdAudAuccudTgAfcuuugaascsa | 1886 | UGUUCAAAGUCAAGGAUAUGGAA | 2599 |

TABLE 3-continued

Modified Sense and Antisense Strand Sequences of Complement Factor B dsRNA Agents

| Duplex Name | Sense Strand Sequence 5' to 3' | SEQ ID NO: | Antisense Strand Sequence 5' to 3' | SEQ ID NO: | mRNA target sequence | SEQ ID NO: |
|---|---|---|---|---|---|---|
| AD-1725482 | uscsaaagucAfAfGfgauauggaauL96 | 1236 | asdTsucdCadTauccdTudGfacuuugasasc | 1887 | GUUCAAAGUCAAGGAUAUGGAAA | 2600 |
| AD-1725483 | csasaagucaAfGfGfauauggaaauL96 | 1237 | asdTsuudCcdAuaucdCuUfgacuuuugsasa | 1888 | UUCAAAGUCAAGGAUAUGGAAAA | 2601 |
| AD-1725534 | usgsaaagcCfAfGfUfcucugagucuL96 | 1238 | asdGsacdTcdAgagadCuUfgcuuucasusc | 1889 | GAUGAAAGCCAGUCUCUGAGUCU | 2602 |
| AD-1725535 | gsasaagccaGfUfCfucugagucuUL96 | 1239 | asdAsgadCudCagagdAcUfggcuuucsasu | 1890 | AUGAAAGCCAGUCUCUGAGUCUC | 2603 |
| AD-1725548 | usgsagucucUfGfUfggcauggguuL96 | 1240 | asdAsacdCadTgccadCadGfagacucasga | 1891 | UCUGAGUCUCUGUGGCAUGGUUU | 2604 |
| AD-1725552 | uscsucgugGfCfAfugguuugggguL96 | 1241 | asdCsccdAadAccaudGcCfacagagascsu | 1892 | AGUCUCUGUGGCAUGGUUUGGGA | 2605 |
| AD-1725556 | usgsuggcauGfGfUfuugggaacauL96 | 1242 | asdTsgudTcdCcaaadCcAfugccacasgsa | 1893 | UCUGUGGCAUGGUUUGGGAACAC | 2606 |
| AD-1725558 | usgsgcauggUfUfUfgggaacacauL96 | 1243 | asdTsgudGudTcccadAaCfcaugccascsa | 1894 | UGUGGCAUGGUUUGGGAACACAG | 2607 |
| AD-1725580 | asasgggguaccCfGfAfuuaccacauL96 | 1244 | asdTsugdTgGuaudCgGfuaccccuuscsc | 1895 | GGAAGGGUACCGAUUACCACAAG | 2608 |
| AD-1725582 | gsgsguaccgAfUfCfAfuuaccacauL96 | 1245 | asdGscudTgdTgguadAuCfgguacccsusu | 1896 | AAGGGUACCGAUUACCACAAGCA | 2609 |
| AD-1725585 | usasccgauuaAfCfCfacaagcaacuL96 | 1246 | asdGsuudGcdTugugdGuAfaucgguascsc | 1897 | GGUACCGAUUACCACAAGCAACC | 2610 |
| AD-1725587 | cscsgauuacCfAfCfaagcaaccauL96 | 1247 | asdTsggdTudGcuugdTgGfuaaucggsusa | 1898 | UACCGAUUACCACAAGCAACCAU | 2611 |
| AD-1725588 | csgsauuaccAfCfAfagcaaccauuL96 | 1248 | asdAsugdGudTgcuudGudGfuaaucgsgsu | 1899 | ACCGAUUACCACAAGCAACCAUG | 2612 |
| AD-1725590 | asusuaccacAfAfGfcaaccauggcL96 | 1249 | asdCscadTgdGuugcdTuGfuggguauscsg | 1900 | CGAUUACCACAAGCAACCAUGGC | 2613 |
| AD-1725591 | ususaccacaAfGfCfcaaccauggcuL96 | 1250 | asdGsccdAudGgugdCuUfguggguaastsc | 1901 | GAUUACCACAAGCAACCAUGGCA | 2614 |
| AD-1725592 | usasccacaaGfCfAfaccauggcauL96 | 1251 | asdTsgcdCadTgguudGcUfugugguasasu | 1902 | AUUACCACAAGCAACCAUGGCAG | 2615 |
| AD-1725593 | ascscacaagCfAfAfccauggcaguL96 | 1252 | asdCsugdCcdAugudGcTgcfuugggusasa | 1903 | UUACCACAAGCAACCAUGGCAGG | 2616 |
| AD-1725598 | asasgcaaccAfUfGfgcaggccaauL96 | 1253 | asdTsugdGcdCugccdAuGfguugcuusgsu | 1904 | ACAAGCAACCAUGGCAGGCCAAG | 2617 |
| AD-1725603 | ascscauggcAfGfGfccaagaucucL96 | 1254 | asdAsgadTcdTuggcdCuGfccauggusug | 1905 | CAACCAUGGCAGGCCAAGAUCUC | 2618 |
| AD-1725604 | cscsauggcaGfGfCfcaagaucucuL96 | 1255 | asdGsagdAudCuuggdCcUfgccauggsusu | 1906 | AACCAUGGCAGGCCAAGAUCUCA | 2619 |
| AD-1725605 | csasauggcagGfCfCfaagaucucuL96 | 1256 | asdTsgadGadTcuugdGcCfugccaugsgsu | 1907 | ACCAUGGCAGGCCAAGAUCUCAG | 2620 |
| AD-1725643 | gscsugugguGfUfCfugaguacuuuL96 | 1257 | asdAsagdTadCucagdAcAfccacagescsc | 1908 | GGGCUGUGGUGUCUGAGUACUUU | 2621 |
| AD-1725644 | csusugguguUfCfUfgaguacuuuL96 | 1258 | asdAsaadGudAcucadGaCfaccacagscsc | 1909 | GCUGUGGUGUCUGAGUACUUUG | 2622 |
| AD-1725645 | usgsugugucUfCfUfgaguacuuuguL96 | 1259 | asdCsaadAgTacucdAgAfcaccacasgsc | 1910 | GCUGUGGUGUCUGAGUACUUUGU | 2623 |

TABLE 3-continued

Modified Sense and Antisense Strand Sequences of Complement Factor B dsRNA Agents

| Duplex Name | Sense Strand Sequence 5' to 3' | SEQ ID NO: | Antisense Strand Sequence 5' to 3' | SEQ ID NO: | mRNA target sequence | SEQ ID NO: |
|---|---|---|---|---|---|---|
| AD-1725646 | gsusggugucUfGfAfguacuuugugL96 | 1260 | asdAscadAadGuacudCaGfacaccacsasg | 1911 | CUGUGGUGUCUGAGUACUUUGUG | 2624 |
| AD-1725647 | usgsgugucuGfAfGfuacuuugugugL96 | 1261 | asdCsacdAadAguacdTcAfgacaccascsa | 1912 | UGUGGUGUCUGAGUACUUUGUGC | 2625 |
| AD-1725667 | csusgacagcAfGfCfacauugugauuL96 | 1262 | asdAsaadCadAugugdCuGfcugucagscsa | 1913 | UGCUGACAGCAGCACAUUGUUUC | 2626 |
| AD-1725716 | asasgcgggaCfCfUfggagauagauL96 | 1263 | asdTscudAudCuccadGgUfcccgcuuscsu | 1914 | AGAAGCGGGACCUGGAGAUAGAA | 2627 |
| AD-1725717 | asgcgggaccCfUfGfgagauagaaUL96 | 1264 | asdTsucdTadTcuccdAgUfuccgcusuusc | 1915 | GAAGCGGGACCUGGAGAUAGAAG | 2628 |
| AD-1725756 | asasgcaggaAfAfUfuccugaauuUL96 | 1265 | asdAsaudTcdAggadTuCfcugcuucsusu | 1916 | AAGAAGCAGGAAUCCUGAAUUU | 2629 |
| AD-1725757 | asasgcaggaAfUfUfccugaauuuaUL96 | 1266 | asdAsaadTudCaggadAuUfccugcuuscsu | 1917 | AGAAGCAGGAAUUCCUGAAUUUAU | 2630 |
| AD-1725759 | gscsaggaauUfCfCfugaauuuauUL96 | 1267 | asdTsaadAadTucagdGaAfuuccugcsusu | 1918 | AAGCAGGAAUUCCUGAAUUUUAU | 2631 |
| AD-1725760 | csaaggaauuCfCfUfgaauuuauaUL96 | 1268 | asdAsuadAadAuucadGgAfauuccugscsu | 1919 | AGCAGGAAUUCCUGAAUUUAUAG | 2632 |
| AD-1725761 | asggaauuccUfGfAfauuuaugauL96 | 1269 | asdCsaudAudAauucdAgGfaauuccugsc | 1920 | GCAGGAAUUCCUGAAUUUAUGA | 2633 |
| AD-1725762 | gsggaauuccUfGfAfauuuaugacUL96 | 1270 | asdTscadTadAaauudCaGfgaauuccsug | 1921 | CAGGAAUUCCUGAAUUUAUGAC | 2634 |
| AD-1725763 | gsasauuccUfGfAfAfuuuaugacuUL96 | 1271 | asdGsucdAudAaaudTcAfggaauucscsu | 1922 | AGGAAUUCCUGAAUUUAUGACU | 2635 |
| AD-1725764 | asasauuccugAfAfUfuuaugacuaUL96 | 1272 | asdAsgudCadTaaadTuCfaggaauuscsc | 1923 | GGAAUUCCUGAAUUUAUGACUA | 2636 |
| AD-1725765 | asusuccugaAfUfUfuaugacuauUL96 | 1273 | asdTsagdTcdAuaaadAuUfcaggaaususc | 1924 | GAAUUCCUGAAUUUAUGACUAU | 2637 |
| AD-1725766 | ususcuugaaUfUfUfuaugacuauuUL96 | 1274 | asdAsuadGudCauaadAaUfucaggaasusu | 1925 | AAUUCCUGAAUUUAUGACUAUG | 2638 |
| AD-1725767 | uscscuugaauUfUfUfaugacuauguL96 | 1275 | asdCsaudAgdTcauadAaAfuucaggasasu | 1926 | AUUCCUGAAUUUAUGACUAUGA | 2639 |
| AD-1725768 | cscsugaauuUfUfAfugacuaugaUL96 | 1276 | asdTscadTadGucaudAaAfauucaggsasa | 1927 | UUCCUGAAUUUAUGACUAUGAC | 2640 |
| AD-1725769 | csusgaauuuUfAfUfgacuaugacUL96 | 1277 | asdGsucdAudAgucadTaAfauucagsgsa | 1928 | UCCUGAAUUUAUGACUAUGACG | 2641 |
| AD-1725771 | gsaaauuuaUfGfAfcuaugacguU | 1278 | asdAscgdTcdAuaguAdCaUfaaaaucsasg | 1929 | CUGAAUUUAUGACUAUGACGUU | 2642 |
| AD-1725772 | asasuuuaugAfCfCfuaugacguuuUL96 | 1279 | asdAsacdGudCauagdTcAfuaaaauscsa | 1930 | UGAAUUUAUGACUAUGACGUUG | 2643 |
| AD-1725773 | asuuuuaugAfCfUfaugacuaugcUL96 | 1280 | asdCsaadCgdTcauadGuCfauaaauusc | 1931 | GAAUUUAUGACUAUGACGUUGC | 2644 |
| AD-1725775 | ususuaugacUfAfUfgacguugccuL96 | 1281 | asdGsgcdAadCgucadTaGfucauaaaasu | 1932 | AUUUAUGACUAUGACGUUGCCC | 2645 |
| AD-1725776 | ususuaugacuAfUfGfacguugcccUL96 | 1282 | asdGsgdCadAcgucdAuAfgucauaasasa | 1933 | UUUUAUGACUAUGACGUUGCCCU | 2646 |
| AD-1725777 | usasagacuaUfGfAfcguugcccuUL96 | 1283 | asdAsggdGcdAacgucdAuUfagucauasa | 1934 | UUUAUGACUAUGACGUUGCCCUG | 2647 |

TABLE 3-continued

Modified Sense and Antisense Strand Sequences of Complement Factor B dsRNA Agents

| Duplex Name | Sense Strand Sequence 5' to 3' | SEQ ID NO: | Antisense Strand Sequence 5' to 3' | SEQ ID NO: | mRNA target sequence | SEQ ID NO: |
|---|---|---|---|---|---|---|
| AD-1725778 | asusgacuauGfAfCfguugcccuguL96 | 1284 | asdCsagdGgdCaacgdTcAfuagucausasa | 1935 | UUAUGACUAUGACGUUGCCCUGA | 2648 |
| AD-1725779 | usgsacuaugAfCfGfuugcccugauL96 | 1285 | asdTscadGgdGcaacdGuCfauagucasusa | 1936 | UAUGACUAUGACGUUGCCCUGAU | 2649 |
| AD-1725780 | gsascuaugaCfGfUfugcccugauuL96 | 1286 | asdAsucdAgdGgcaadCgUfcauagucsasu | 1937 | AUGACUAUGACGUUGCCCUGAUC | 2650 |
| AD-1725784 | asusgacguuGfCfCfcugaucaaguL96 | 1287 | asdCsuudGadTcaggdGcAfacgucausasg | 1938 | CUAUGACGUUGCCCUGAUCAAGC | 2651 |
| AD-1725785 | usgsacguugCfCfCfugaucaagcuL96 | 1288 | asdGscudTgdAucadGgCfaacgucasusa | 1939 | UAUGACGUUGCCCUGAUCAAGCU | 2652 |
| AD-1725786 | gsascguugcCfCfUfgaucaagcuuL96 | 1289 | asdAsgcdTudGaucadGgGfcaacgucsasu | 1940 | AUGACGUUGCCCUGAUCAAGCUC | 2653 |
| AD-1725787 | ascsguugccCfUfUfgaucaagcucuL96 | 1290 | asdGsagdCudTgaucdAgGfgcaacgucscsa | 1941 | UGACGUUGCCCUGAUCAAGCUCA | 2654 |
| AD-1725789 | gsusguugcccUfGfAfUfcaagcucaauL96 | 1291 | asdTsugdAgdCuugadTcAfgggcaacsgsu | 1942 | ACCUUGCCCUGAUCAAGCUCAAG | 2655 |
| AD-1725790 | ususgcccugAfUfCfaagcucaaguL96 | 1292 | asdCsuudGadGcuugdAuUfagggcaascsg | 1943 | CGUUGCCCUGAUCAAGCUCAAGA | 2656 |
| AD-1725828 | csasgacuauCfAfGfgcccauuuguL96 | 1293 | asdCsaadAudGgggcdTgAfuagucugsgsc | 1944 | GCCAGACUAUCAGGCCCAUUUGU | 2657 |
| AD-1725829 | asgsacuaucAfGfGfcccauuugucL96 | 1294 | asdAscadAadTgggcdGcAfauagucusgsg | 1945 | CCAGACUAUCAGGCCCAUUUGUC | 2658 |
| AD-1725830 | gsascuaucaGfGfCfccauuugucuL96 | 1295 | asdGsacdAadAugggdGcCfugauagucsusg | 1946 | CAGACUAUCAGGCCCAUUUGUCU | 2659 |
| AD-1725831 | ascsuaucagGfCfCfcauuugucucL96 | 1296 | asdAsgadCadAauuggdGcCfugauagusscu | 1947 | AGACUAUCAGGCCCAUUUGUCUC | 2660 |
| AD-1725832 | csusaucaggCfCfCfauuugucucuL96 | 1297 | asdGsagdAcAaauugdGgCfcugauagsusc | 1948 | GACUAUCAGGCCCAUUUGUCUCC | 2661 |
| AD-1725840 | csgsagggaaCfAfAfcucgagcuuuL96 | 1298 | asdAsagdCudCgagudTgUfucccucgsgsu | 1949 | ACCGAGGGAACAACUCGAGCUUU | 2662 |
| AD-1725841 | gsasgggaacAfAfCfucgagcuuuuL96 | 1299 | asdAsaadGcdTcgagdTuGfuucccucsgsg | 1950 | CCGAGGGAACAACUCGAGCUUUG | 2663 |
| AD-1725842 | asgsggaacaAfCfUfcgagcuuugaL96 | 1300 | asdCsaadAgdCucgadGuUfguucccuscsg | 1951 | CGAGGGAACAACUCGAGCUUUGA | 2664 |
| AD-1725845 | gsascaacucUfCfGfAfgcuuugagguL96 | 1301 | asdCscudCadAagcudGcGfAfguugucscsc | 1952 | GGGAACAACUCGAGCUUUGAGGC | 2665 |
| AD-1725846 | asascaacucGfAfGfcuuugaggcuL96 | 1302 | asdGsccdTcdAaagcdTcGfagucgucssc | 1953 | GGAACAACUCGAGCUUUGAGGCU | 2666 |
| AD-1725848 | csasucucgaGfCfUfuugaggcuuuL96 | 1303 | asdAsagdCcdTcaaadGcUfcgagungsgsc | 1954 | AACAACUCGAGCUUUGAGGCUUC | 2667 |
| AD-1725849 | asasucucgaGfCfUfuugaggcuucuL96 | 1304 | asdGsaadGcdCucaadAgCfucgagunsgsu | 1955 | ACAACUCGAGCUUUGAGGCUUCC | 2668 |
| AD-1725850 | ascsucgagCfUfUfUfgaggcuuccuL96 | 1305 | asdGsgadAgdCcucadAaGfcucgagusu | 1956 | CAACUCGAGCUUUGAGGCUUCCU | 2669 |
| AD-1725854 | gsaagcuuugAfGfGfcuuccuccauL96 | 1306 | asdTsggdAgdGaagcdCuCfaaagcucsgsa | 1957 | UCGAGCUUUGAGGCUUCCUCCAA | 2670 |
| AD-1725855 | asgsscuuugaGfGfCfuuccuccaacL96 | 1307 | asdTsugdAGdGaagdCcUfcaaagcuscsg | 1958 | CGAGCUUUGAGGCUUCCUCCAAC | 2671 |

TABLE 3-continued

Modified Sense and Antisense Strand Sequences of Complement Factor B dsRNA Agents

| Duplex Name | Sense Strand Sequence 5' to 3' | SEQ ID NO: | Antisense Strand Sequence 5' to 3' | SEQ ID NO: | mRNA target sequence | SEQ ID NO: |
|---|---|---|---|---|---|---|
| AD-1725856 | gscsuuugagGfCfUfuccuccaacuL96 | 1308 | asdGsuudGgdAggaadGcCfucaaagcsusc | 1959 | GAGCUUUGAGGCUUCCUCCAACU | 2672 |
| AD-1725857 | csusuugaggCfUfUfcccuccaacuuL96 | 1309 | asdAsgudTgdGaggadAgcCfcucaaagscsu | 1960 | AGCUUUGAGGCUUCCUCCAACUA | 2673 |
| AD-1725858 | ususugaggcUfUfCfcuccaacuacuL96 | 1310 | asdTsagdTudGgaggdAaGfccucaaagsc | 1961 | GCUUUGAGGCUUCCUCCAACUAC | 2674 |
| AD-1725861 | gsasggcuucCfUfCfcaacuaccacuL96 | 1311 | asdTsggdTadGuuggdAgGfaagccucsasa | 1962 | UUGAGGCUUCCUCCAACUACCAC | 2675 |
| AD-1725862 | asggcuucCfUfCfaacuaccacuL96 | 1312 | asdGsugdGudAguugdGaGfgaagccucssa | 1963 | UGAGGCUUCCUCCAACUACCACU | 2676 |
| AD-1725864 | gscuuccucCfAfAfcuaccacuuuL96 | 1313 | asdAsagdTgdGuaguddTgGfaggaagcscsu | 1964 | AGGCUUCCUCCAACUACCACUUG | 2677 |
| AD-1725866 | ususccuccaAfCfUfaccacugccuL96 | 1314 | asdGscadAgdTgguadGuTfggaggaasgsc | 1965 | GCUUCCUCCAACUACCACUGCC | 2678 |
| AD-1725867 | uscsuccaCfUfAfccacuugccauL96 | 1315 | asdGsgcadAadGuggudAgUfuggagasasg | 1966 | CUUCCUCCAACUACCACUUGCCA | 2679 |
| AD-1725872 | csaasacuacAfCfUfugcagcaauL96 | 1316 | asdTsugdCudGgcaadGuGfcaadGfuagsgsa | 1967 | UCCAACUACCACUUGCCAGCAAC | 2680 |
| AD-1725874 | ascsuaccacUfUfGfccagcaacauL96 | 1317 | asdTsgudTgdCuggcdAaGfugguagususg | 1968 | CAACUACCACUUGCCAGCAACAA | 2681 |
| AD-1725907 | csusccugcAfCfAfggauaucaaaL96 | 1318 | asdTsugdAudAuccudGuGfcaggagagscsa | 1969 | UGCUCCCUGCACAGGAUAUCAAA | 2682 |
| AD-1725908 | uscscugcaCfAfGfgauaucaaagL96 | 1319 | asdTsuudGadTauccdTgUfgcaggdgasgsc | 1970 | GCUCCCUGCACAGGAUAUCAAAG | 2683 |
| AD-1725909 | csusgcagGfAfUfaucaaagcuuL96 | 1320 | asdCsuudTgdAuaucdCuGfugcagusgsag | 1971 | CUCCCUGCACAGGAUAUCAAAGC | 2684 |
| AD-1725911 | csusgcagGfAfUfaucaaagcuuL96 | 1321 | asdAsgcdTudTgauaddTcCfugucagsgsag | 1972 | CCCUGCACAGGAUAUCAAAGCUC | 2685 |
| AD-1725916 | csasggauauAfAfAfagcucuguuuL96 | 1322 | asdAsacdAgdAgcuudTgAfuauccugsusg | 1973 | CACAGGAUAUCAAAGCUCUGUUU | 2686 |
| AD-1725919 | gsasuaucaaAfGfCfucuguuuguuL96 | 1323 | asdAscadAadCagagdCuTfugauauscsu | 1974 | AGGAUAUCAAAGCUCUGUUUGUG | 2687 |
| AD-1725925 | asaagcucuGfUfUfugugucugauL96 | 1324 | asdTscadGadCacaadAcAfgagcuuusgsa | 1975 | UCAAAGCUCUGUUUGUGUCUGAG | 2688 |
| AD-1725957 | gscsugacucCfGfAfaggaggucuaL96 | 1325 | asdAsgadCcdTccuudCcGfagucagesusu | 1976 | AAGCUGACUCGGAAGGAGGUCUA | 2689 |
| AD-1725958 | csusgacucgGfAfAfggaggucuaaL96 | 1326 | asdTsagdAcdCuccudTcCfgagucagscsu | 1977 | AGCUGACUCGGAAGGAGGUCUAC | 2690 |
| AD-1725961 | ascsucgaaGfGfAfggucuacauuL96 | 1327 | asdAsugdTadGaccudCcUfuccgaguscsa | 1978 | UGACUCGGAAGGAGGUCUACAUC | 2691 |
| AD-1725963 | uscsggaagGfAfGfgcuacaucauL96 | 1328 | asdTsgadTgdTagacdCuTfcuccgasgsu | 1979 | ACUCGGAAGGAGGUCUACAUCAA | 2692 |
| AD-1725964 | csggaaggAfGfGfucuacaucaauL96 | 1329 | asdTsugdAudGuagadCcUfcuuccgsaag | 1980 | CUCGGAAGGAGGUCUACAUCAAG | 2693 |
| AD-1725967 | asaasggaggAfGfAfccucaagaauL96 | 1330 | asdTsucdTudGaugudAgAfccucccususc | 1981 | GGAAGGAGGUCUACAUCAAGAAU | 2694 |
| AD-1725968 | asggaggucUfAfCfaucaagaauL96 | 1331 | asdAsuudCudT gaugdTagdfaccucususc | 1982 | GAAGGAGGUCUACAUCAAGAAUG | 2695 |

TABLE 3-continued

Modified Sense and Antisense Strand Sequences of Complement Factor B dsRNA Agents

| Duplex Name | Sense Strand Sequence 5' to 3' | SEQ ID NO: | Antisense Strand Sequence 5' to 3' | SEQ ID NO: | mRNA target sequence | SEQ ID NO: |
|---|---|---|---|---|---|---|
| AD-1725974 | asasgaaaggCfAfGfcugugagaguL96 | 1332 | asdCsucdTcdAcagedTgCfcuuucuusasu | 1983 | AUAAGAAAGGCAGCUGUGAGAGA | 2696 |
| AD-1725977 | asasaggcagCfUfGfugagagagauL96 | 1333 | asdTsccudCudCucacdAgvCfugccuuuscsu | 1984 | AGAAAGGCAGCUGUGAGAGAGAU | 2697 |
| AD-1725983 | asgscugugaGfAfGfagagugcucauL96 | 1334 | asdTsgadGcdAucucdTcdTfcacagcucagsc | 1985 | GCAGCUGUGAGAGAGAUGCUCAA | 2698 |
| AD-1725985 | csusgugagaGfAfGfaugcucaauuL96 | 1335 | asdAsuudGadGcaucdTcdTfcucacagscsu | 1986 | AGCUGUGAGAGAGAUGCUCAAUA | 2699 |
| AD-1725986 | usgsugagagGfAfGfAfugcucaauauuL96 | 1336 | asdTsaudTgdAgcaudCuCfucucacasgsc | 1987 | GCUGUGAGAGAGAUGCUCAAUAU | 2700 |
| AD-1725987 | gsusgagagaGfAfUfgcucaauauuL96 | 1337 | asdAsuadTudGagcadTcUfcucucacasag | 1988 | CUGUGAGAGAGAUGCUCAAUAUG | 2701 |
| AD-1725988 | usgsagagagAfAfUfgcucaauaugcuL96 | 1338 | asdCsaudAudTgagcdAuCfucucucascsa | 1989 | UGUGAGAGAGAUGCUCAAUAUGC | 2702 |
| AD-1725989 | gsasagagagaUfGfCfucaauaugcuL96 | 1339 | asdGscadTadTugagdCaUfcucucucsasc | 1990 | GUGAGAGAGAUGCUCAAUAUGCC | 2703 |
| AD-1725991 | csaasggcuauGfAfCfaaagucaaguL96 | 1340 | asdCsuudGadCuuugdTcAfuagccugssgg | 1991 | CCCAGGCUAUGACAAAGUCAAGG | 2704 |
| AD-1725992 | asggscuaugaAfCfAfAfagucaagguL96 | 1341 | asdCscudTgdAcuuudGuCfauagccusgg | 1992 | CCAGGCUAUGACAAAGUCAAGGA | 2705 |
| AD-1725993 | gsggscuaugaCfAfAfagucaagguL96 | 1342 | asdTsccdTudGacuudTgUfcauagccsug | 1993 | CAGGCUAUGACAAAGUCAAGGAC | 2706 |
| AD-1725999 | gsascaaaguCfAfAfgacaucucuL96 | 1343 | asdGsagdAudGuccudTgAfcuuugucsasu | 1994 | AUGACAAAGUCAAGGACAUCUCA | 2707 |
| AD-1726014 | uscsggsuuccUfUfGfuacuggaguL96 | 1344 | asdCsucdCadGuacadAaGfgaaccgasgsg | 1995 | CCUCGGUUCCUUUGUACUGGAGG | 2708 |
| AD-1726015 | csggsuuccuuUfUfGfuacuggagguL96 | 1345 | asdCscudCcdAguacdCaAfggaaccgsasg | 1996 | CUCGGUUCCUUUGUACUGGAGGA | 2709 |
| AD-1726016 | gsgsuuccuuUfGfUfuacuggaggauL96 | 1346 | asdTsccdTcdCaguadCaAfaggaaccsgsa | 1997 | UCGGUUCCUUUGUACUGGAGGAG | 2710 |
| AD-1726018 | ususccuugUfAfCfuggagguuL96 | 1347 | asdAscudCcdTccagdTaCfaaaggaascsc | 1998 | GGUUCCUUUGUACUGGAGGAGUG | 2711 |
| AD-1726020 | cscsuuuguaCfUfGfgagaguagsasa | 1348 | asdTscadCudCccuccdAgvfacaaaggsasa | 1999 | UUCCUUUGUACUGGAGGAGUGAG | 2712 |
| AD-1726023 | ususguacugGfAfGfgagugaguccuL96 | 1349 | asdGsacdTcdAcucccdTcCfaguacaaasag | 2000 | CUUUGUACUGGAGGAGUGAGUCC | 2713 |
| AD-1726024 | usgsuacuggAfGfGfagugaguccuL96 | 1350 | asdGsgadCudCacucdCuCfcaguacasasa | 2001 | UUUGUACUGGAGGAGUGAGUCCC | 2714 |
| AD-1726025 | gsusacuggaGfGfAfgugaguccuL96 | 1351 | asdGsggdAcdTcacudCcUfccaguacsasg | 2002 | UUGUACUGGAGGAGUGAGUCCCU | 2715 |
| AD-1726027 | ascsuggaggAfGfUfgaguccuuL96 | 1352 | asdTsagdGgdAcucadCuCfcucagusasc | 2003 | GUACUGGAGGAGUGAGUCCCUAU | 2716 |
| AD-1726029 | usgsgaggagUfGfAfguccuaugcuL96 | 1353 | asdCsaudAgdGgacudCaCfuccucasgsu | 2004 | ACUGGAGGAGUGAGUCCCUAUGC | 2717 |
| AD-1726031 | gsaasggagugAfGfUfcccuaugcuuL96 | 1354 | asdAsgcdAudAgggadCuCfacuccucsca | 2005 | UGGAGGAGUGAGUCCCUAUGCUG | 2718 |
| AD-1726033 | gsgsagagugagUfCfCfcuaugcugauL96 | 1355 | asdTscadGcdAuaggdGaCfucacuccsusc | 2006 | GAGGAGUGAGUCCCUAUGCUGAC | 2719 |

TABLE 3-continued

Modified Sense and Antisense Strand Sequences of Complement Factor B dsRNA Agents

| Duplex Name | Sense Strand Sequence 5' to 3' | SEQ ID NO: | Antisense Strand Sequence 5' to 3' | SEQ ID NO: | mRNA target sequence | SEQ ID NO: |
|---|---|---|---|---|---|---|
| AD-1726034 | gsasgugagucCfCfCfuaugcugacuL96 | 1356 | asdGsucdAgdCauagdGgAfcucacucscsu | 2007 | AGGAGUGAGUCCUAUGCUGACC | 2720 |
| AD-1726036 | csasauacuugCfCfAfgaggugauuuL96 | 1357 | asdAsaudCadCcucudGcAfaguauugsgsg | 2008 | CCCAAUACUUGCAGAGGUGAUUC | 2721 |
| AD-1726037 | asasuacuugCfAfGfaggugauucuL96 | 1358 | asdGsaadTcdAccucdTgcCfaaguauusgsg | 2009 | CCAAUACUUGCAGAGGUGAUUCG | 2722 |
| AD-1726039 | usascuugcagGfAfGfgugauucuguL96 | 1359 | asdCsagdAadTcaccdTcUfgcaaguasusu | 2010 | AAUACUUGCAGAGGUGAUUCUGG | 2723 |
| AD-1726041 | csusugcagaGfGfUfgauucuggcuL96 | 1360 | asdGsccdAgdAaucadCcUfcugcaagsusa | 2011 | UACUUGCAGAGGUGAUUCUGGCG | 2724 |
| AD-1726042 | ususgcagagGfUfGfauucuggcguL96 | 1361 | asdCsgcdCadGaaucdAcCfucugcaasgsu | 2012 | ACUUGCAGAGGUGAUUCUGGCGG | 2725 |
| AD-1726048 | usgsauaguuCfAfCfaagagaaguuL96 | 1362 | asdAscudTcdTcuugdTgAfacuaucasasg | 2013 | CUUGAUAGUUCACAAGAGAAGUC | 2726 |
| AD-1726049 | gsasuaguucAfCfAfagagaagucuL96 | 1363 | asdGsacdTudCucuudGuGfaacuaucsasa | 2014 | UUGAUAGUUCACAAGAGAAGUCG | 2727 |
| AD-1726050 | asusuaguucaCfAfAfgagaagucguL96 | 1364 | asdCsgadCudTcucudTgUfgaacuauscsa | 2015 | UGAUAGUUCACAAGAGAAGUCGU | 2728 |
| AD-1726051 | usasguucacaAfAfGfagaagucguuL96 | 1365 | asdAscgdAcdTucucdTuGfugaacuausus | 2016 | GAUAGUUCACAAGAGAAGUCGUU | 2729 |
| AD-1726052 | asgsuucacaaGfAfGfaagucguuuL96 | 1366 | asdAsacdGadAcucdCuUfcugugaacsusa | 2017 | AUAGUUCACAAGAGAAGUCGUUU | 2730 |
| AD-1726053 | gsusucacaagAfGfAfagucguuucuL96 | 1367 | asdAsaadCgdAcucdTcUfugugaacusus | 2018 | UAGUUCACAAGAGAAGUCGUUUC | 2731 |
| AD-1726054 | ususucacaagAfGfAfagucguuucuL96 | 1368 | asdGsaadAcdAcGacudCuCfuugugaascsu | 2019 | AGUUCACAAGAGAAGUCGUUUCA | 2732 |
| AD-1726055 | uscascacagaGfAfAfgucguuucauL96 | 1369 | asdTsgadAadCgacudTcUfcuugugasasc | 2020 | GUUCACAAGAGAAGUCGUUUCAU | 2733 |
| AD-1726056 | csascagagAfAfGfucguuucauuL96 | 1370 | asdAsugdAadAcgacdTucTfucuugugsasa | 2021 | UUCACAAGAGAAGUCGUUUCAUU | 2734 |
| AD-1726057 | ascsaagagaAfGfUfcguuucauuuL96 | 1371 | asdAsaudGadAacgadCuUfcucuugusgsa | 2022 | UCACAAGAGAAGUCGUUUCAUUC | 2735 |
| AD-1726058 | csasaagagaaGfUfCfguuucauucuL96 | 1372 | asdGsaadTgdAaacgdAcUfucucuugsusg | 2023 | CACAAGAGAAGUCGUUUCAUUCA | 2736 |
| AD-1726059 | asasagagaagUfCfGfuuucauucauL96 | 1373 | asdTsgadAudGaaacdGaCfuucucuusgsu | 2024 | ACAAGAGAAGUCGUUUCAUUCAA | 2737 |
| AD-1726060 | asgsagaaguCfGfUfuuucauucauL96 | 1374 | asdTsugdAadTgaaacdGaAfcuucuusug | 2025 | CAAGAGAAGUCGUUUCAUUCAAG | 2738 |
| AD-1726061 | gsasgaagucGfUfUfucauucaaguL96 | 1375 | asdCsuudGadAugaadAcGfacuucucsusu | 2026 | AAGAGAAGUCGUUUCAUUCAAGU | 2739 |
| AD-1726062 | asgsaagucgUfUfUfcauucaaguuL96 | 1376 | asdAscudTgdAauugadAaCfgacuucscsu | 2027 | AGAGAAGUCGUUUCAUUCAAGUU | 2740 |
| AD-1726063 | gsasaguucgUfUfCfauucaaguuL96 | 1377 | asdAsacdTudGaaugdAaAfcgacuucsusc | 2028 | GAGAAGUCGUUUCAUUCAAGUUG | 2741 |
| AD-1726064 | asasaguucguUfCfAfuucaaguuguL96 | 1378 | asdCsaadCudTgaaudGaAfacgacuusscu | 2029 | AGAAGUCGUUUCAUUCAAGUUGG | 2742 |
| AD-1726065 | asgsucguuuCfAfUfucaaguugguL96 | 1379 | asdCsscadAcdTugaadTgAfaacgacuusc | 2030 | GAAGUCGUUUCAUUCAAGUUGGU | 2743 |

TABLE 3-continued

Modified Sense and Antisense Strand Sequences of Complement Factor B dsRNA Agents

| Duplex Name | Sense Strand Sequence 5' to 3' | SEQ ID NO: | Antisense Strand Sequence 5' to 3' | SEQ ID NO: | mRNA target sequence | SEQ NO: |
|---|---|---|---|---|---|---|
| AD-1726079 | gsasguaguggGfAfUfgucugcaaauL96 | 1380 | asdTsuudGcdAgacadTcCfacucucscsc | 2031 | GGGAGUAGUGGAUGUCUGCAAAA | 2744 |
| AD-1726080 | asgsuaguggAfUfGfucugcaaaauL96 | 1381 | asdTsuudTgdCagacdAuCfcacuacuscsc | 2032 | GGAGUAGUGGAUGUCUGCAAAAA | 2745 |
| AD-1726081 | gsusaguggaUfGfUfcugcaaaaauL96 | 1382 | asdTsuudTudGcagadCaUfccacuacsusc | 2033 | GAGUAGUGGAUGUCUGCAAAAAC | 2746 |
| AD-1726082 | usasguggauGfUfCfugcaaaaacuL96 | 1383 | asdGsuudTudTgcagdAcAfuccacuacscsu | 2034 | AGUAGUGGAUGUCUGCAAAAACC | 2747 |
| AD-1726083 | asgsuggaugUfCfUfgcaaaaaccuL96 | 1384 | asdGsgudTudTugcadGacTfauccacuasasc | 2035 | GUAGUGGAUGUCUGCAAAAACCA | 2748 |
| AD-1726084 | gsusggaugucUfUfGfcaaaaaccauL96 | 1385 | asdTsggdTudTuugcdAgAfcauccacusasa | 2036 | UAGUGGAUGUCUGCAAAAACCAG | 2749 |
| AD-1726085 | usgsgaugucUfGfCfaaaaaccaguL96 | 1386 | asdCsugdGudTuuugdCaGfacauccascsu | 2037 | AGUGGAUGUCUGCAAAAACCAGA | 2750 |
| AD-1726086 | gsgsaugucugCfAfAfaaaaccagauL96 | 1387 | asdTscudGgdTuuuudGcAfgacauccsascsc | 2038 | GUGGAUGUCUGCAAAAACCAGAA | 2751 |
| AD-1726087 | gsasugucugCfAfAfaaaaccagaauL96 | 1388 | asdTsucdTgdGuuuudTgcFfagacaucscsa | 2039 | UGGAUGUCUGCAAAAACCAGAAG | 2752 |
| AD-1726090 | gsusucugcaaAfAfAfccagaagcguL96 | 1389 | asdCsgcdTudCuggudTuUfugcagascsa | 2040 | AUGUCUGCAAAAACCAGAAGCGG | 2753 |
| AD-1726091 | uscstugcaaaAfAfCfcagaagcgguL96 | 1390 | asdCscgdCudTcuggdTuUfuugcagascsa | 2041 | UGUCUGCAAAAACCAGAAGCGGC | 2754 |
| AD-1726092 | csusgcaaaaAfCfCfagaagcggcuL96 | 1391 | asdGsccdGcdTucugdGuUfuuugcagsasc | 2042 | GUCUGCAAAAACCAGAAGCGGCA | 2755 |
| AD-1726095 | csaasaaaaccAfGfAfagcggcaaauL96 | 1392 | asdTsuudGcdCgcuudCuGfguuuuugscsa | 2043 | UGCAAAAACCAGAAGCGGCAAAA | 2756 |
| AD-1726096 | asasaaaaccaGfAfAfgcggcaaaauL96 | 1393 | asdTsuudTgdCcgcudTcUfgguuuusgsc | 2044 | GCAAAAACCAGAAGCGGCAAAAG | 2757 |
| AD-1726097 | asasaaaccagAfAfGfcfggcaaaaguL96 | 1394 | asdCsuudTudGccgcdTucTfuggutuusug | 2045 | CAAAAACCAGAAGCGGCAAAAGC | 2758 |
| AD-1726098 | asasaaccagaAfGfCfggcaaaagcuL96 | 1395 | asdGscudTudTgccgdCuUfcugguuusu | 2046 | AAAAACCAGAAGCGGCAAAAGCA | 2759 |
| AD-1726099 | asasaccagaAfGfCfggcaaaagcauL96 | 1396 | asdTsgcdTudTugccdGcUfucugguusu | 2047 | AAAACCAGAAGCGGCAAAAGCAG | 2760 |
| AD-1726103 | asgsaagcggCfAfAfaagcagguauL96 | 1397 | asdTsacdCudGcuuudTgcFfcgcuucusgg | 2048 | CCAGAAGCGGCAAAAGCAGGUAC | 2761 |
| AD-1726113 | asaaagcaggUfAfCfcugcucacguL96 | 1398 | asdCsgudGadGcaggdTacFfccugcuuusug | 2049 | CAAAAGCAGGUACCUGCUCACGC | 2762 |
| AD-1726159 | csasagugcuGfCfCfcuggcugaauL96 | 1399 | asdTsucdAgdCcaggdGcAfgcacuugsasa | 2050 | UUCAAGGCUGCCCCUGGCUGAAG | 2763 |
| AD-1726171 | usgsgcugaaGfAfGfaaacuccauL96 | 1400 | asdTsggdAgdTuucudCcUfcagccasgsg | 2051 | CCUGGCUGAAGGAGAAACUCCAA | 2764 |
| AD-1726184 | asascuccaaGfAfUfgaggauuugcuL96 | 1401 | asdCsaadAudCcucadTcUfuggaguusuc | 2052 | GAAACUCCAAGAUGAGGAUUUGG | 2765 |
| AD-1726187 | uscscaagauGfAfGfgauuuggguuL96 | 1402 | asdAsccdCadAauccdTcAfucuuggasgsu | 2053 | ACUCCAAGAUGAGGAUUUGGGUU | 2766 |
| AD-1726189 | csasagaugaGfGfAfuuugggguuuL96 | 1403 | asdAsaadCcdAcaaudCcUfcaucuugsgsa | 2054 | UCCAAGAUGAGGAUUUGGGUUUU | 2767 |

TABLE 3-continued

Modified Sense and Antisense Strand Sequences of Complement Factor B dsRNA Agents

| Duplex Name | Sense Strand Sequence 5' to 3' | SEQ ID NO: | Antisense Strand Sequence 5' to 3' | SEQ ID NO: | mRNA target sequence | SEQ ID NO: |
|---|---|---|---|---|---|---|
| AD-1726191 | asgsaugaggAfUfUfuggguuuucuL96 | 1404 | asdGsaadAadCccaadAuCfcucaucususg | 2055 | CAAGAUGAGGAUUUGGGUUUCU | 2768 |
| AD-1726201 | gsusgggauuGfAfAfuuaaaacaguL96 | 1405 | asdCsugdTudTuaaudTcAfauccacsgsc | 2056 | GCGUGGGAUUGAAUUAAAACAGC | 2769 |
| AD-1726202 | usgsggauugAfAfAfuaaaacagcuL96 | 1406 | asdGscudGcudTuuaadTuCfaauccascsg | 2057 | CGUGGGAUUGAAUUAAAACAGCU | 2770 |
| AD-1726203 | gsgsgauugaAfAfUfUfaaaacagcuL96 | 1407 | asdAsgcdTgdTuuuadAuUfcaauccasasc | 2058 | GUGGGAUUGAAUUAAAACAGCUG | 2771 |
| AD-1726206 | asusugaauuAfAfAfacagcugcuL96 | 1408 | asdCsgcdAgdCuguudTuAfauucaauscsc | 2059 | GGAUUGAAUUAAAACAGCUGGA | 2772 |
| AD-1726207 | ususgaauuaAfAfAfcagcugcgauL96 | 1409 | asdTscgdCadCugudTuUfaauucaasusc | 2060 | GAUUGAAUUAAAACAGCUGCGAC | 2773 |
| AD-1726208 | usgsaauuaaAfAfCfagcugcgacuL96 | 1410 | asdGsucdGcAgcugdTuUfuaauucasasu | 2061 | AUUGAAUUAAAACAGCUGCGACA | 2774 |
| AD-1726209 | gsasauuaaaAfCfAfgcugcgacauL96 | 1411 | asdTsgudCgdCagcudGuUfuuaauucsasa | 2062 | UUGAAUUAAAACAGCUGCGACAA | 2775 |
| AD-1726815 | csusggcuUfcUfAfCfccguaccccuuL96 | 1412 | asAfsgggUfacgguaGfaAfgcagsasa | 2063 | UUCUGGCUUCUACCCGUACCCUG | 2406 |
| AD-1726927 | cscscuacUfacAfAfUfgugaugaugauL96 | 1413 | asUfscacUfcacauugUfaGfuagggsasg | 2064 | CUCCCUACUACAAUGUGAGUGAU | 2407 |
| AD-1726928 | cscsuacuAfcAfUfUfgugaugauuL96 | 1414 | asAfsucaCfucacauuGfuAfguaggsgsa | 2065 | UCCCUACUACAAUGUGAGUGAUG | 2408 |
| AD-1726931 | ascsuacaAfuGfUfGfagugaugagulL96 | 1415 | asCfsucaUfcacucaCfAfUfguagusasg | 2066 | CUACUACAAUGUGAGUGAUGAGA | 2409 |
| AD-1726934 | ascsaaugUfgAfGfUfGfgaugagaucuL96 | 1416 | asGfsaucUfcaucacuCfaCfauugusasg | 2067 | CUACAAUGUGAGUGAUGAGAUCU | 2410 |
| AD-1726935 | csasaugUfgAfGfUfGfaugagaucuuL96 | 1417 | asGfsgauCfucaucaCfAfcauugsusa | 2068 | UACAAUGUGAGUGAUGAGAUCUC | 2411 |
| AD-1726936 | asasaugUfgAfgUfGfAfugagaucuuL96 | 1418 | asGfsagaUfcucucaCfuCfacausgsu | 2069 | ACAAUGUGAGUGAUGAGAUCUCU | 2412 |
| AD-1726937 | asusgugaGfuGfAfUfGfagaucucuuL96 | 1419 | asUfsgagAfucucauCfAfccausugu | 2070 | CAAUGUGAGUGAUGAGAUCUCUU | 2413 |
| AD-1726938 | usgsugagUfgAfUfGfAfgaucucuuuL96 | 1420 | asAfsagaGfaucucauCfaCfcucacasu | 2071 | AAUGUGAGUGAUGAGAUCUCUUU | 2414 |
| AD-1726939 | gsusgaugUfgAfUfGfAfgaucucuuuL96 | 1421 | asAfsaagAfgaucucaUfCfAfcucacsasu | 2072 | AUGUGAGUGAUGAGAUCUCUUUC | 2415 |
| AD-1726940 | usgsaugaGfAfUfGfAfgaucucuuucuL96 | 1422 | asGfsaaaAfgaucucAfuCfacucascsa | 2073 | UGUGAGUGAUGAGAUCUCUUUCC | 2416 |
| AD-1726941 | gsasugaUfgAfGfGfAfucucuuucculL96 | 1423 | asGfsaaaAfagagauUfCfAfcacucsasc | 2074 | GUGAGUGAUGAGAUCUCUUUCCA | 2417 |
| AD-1726942 | asgsugauGfaGfAfUfcucuuucuuL96 | 1424 | asUfsggaAfagagauUfCfacucuscsa | 2075 | UGAGUGAUGAGAUCUCUUUCCAC | 2418 |
| AD-1726944 | usgsaugaGfaUfCfUfCfuuuccacuL96 | 1425 | asGfsgugGfaaagagaUfCfcaucascsu | 2076 | AGUGAUGAGAUCUCUUUCCACUG | 2420 |
| AD-1726952 | uscsucuuUfcCfAfCfugcuaugacuL96 | 1426 | asGfsucaUfagcagugGfaAfagagasuc | 2077 | GAUCUCUUUCCACUGCUAUGACG | 2423 |
| AD-1726961 | ascsugcuAfCfGfCfugguuacacuL96 | 1427 | asAfsgugUfaaccgucAfuAfgcagsgsg | 2078 | CCACUGCUAUGACGGUUACACUC | 2426 |

TABLE 3-continued

Modified Sense and Antisense Strand Sequences of Complement Factor B dsRNA Agents

| Duplex Name | Sense Strand Sequence 5' to 3' | SEQ ID NO: | Antisense Strand Sequence 5' to 3' | SEQ ID NO: | mRNA target sequence | SEQ ID NO: |
|---|---|---|---|---|---|---|
| AD-1727012 | csaagacaGfcGfAfUfcugugacaauL96 | 1428 | asUfsuguCfacagaucGfc Ufgucugscsu | 2079 | GGCAGACAGCGAUCUGUGACAAC | 2433 |
| AD-1727059 | csusugaaGfacCfAfGfcgucaccuauL96 | 1429 | asUfsaggUfgacgcugUfcUfucaagsgsc | 2080 | GCCUUGAAGACAGCGUCACCUAC | 2441 |
| AD-1727140 | asaagacuCfcUfUfCfauguacgacuL96 | 1430 | asGfsucgUfacaugaaGfgAfgucuusgsg | 2081 | CCAAGACUCCUUCAUGUACGACA | 2451 |
| AD-1727142 | gsascuccUfuCfAfUfguacgacaccL96 | 1431 | asGfsuguCfguacaugAfaGfgagucsusu | 2082 | AAGACUCCUUCAUGUACGACACC | 2452 |
| AD-1727181 | asgsagacCfaUfAfGfaaggagucguL96 | 1432 | asCfsgacUfccuucuaUfgGfucucugsu | 2083 | ACAGAGACCAUAGAAGGAGUCGA | 2455 |
| AD-1727183 | asgsaccaUfaGfAfAfgagucgaugL96 | 1433 | asAfsucgAfcucucucUfaUfggucuscsu | 2084 | AGAGACCAUAGAAGGAGUCGAUG | 2457 |
| AD-1727184 | gsasccauAfgAfAfGfgagucgauuL96 | 1434 | asCfsaucGfacuccuCfuAfuggucsusc | 2085 | GAGACCAUAGAAGGAGUCGAUGC | 2458 |
| AD-1727249 | usgsaacaUfcUfAfCfcuggugcuauL96 | 1435 | asUfsagcAfccaggugGfaUfguucasusg | 2086 | CAUGAACAUCUACCUGGUGCUAG | 2463 |
| AD-1727261 | usgsugcaGfaUfGfGfaucagacaguL96 | 1436 | asCfsucgUfauccaucUfaGfcaccasgsg | 2087 | CCUGGUGCUAGAUGGAUCAGACA | 2472 |
| AD-1727263 | gsusgcuaGfaUfGfGfaucagacagcL96 | 1437 | asCfsuguCfugauccaUfcUfagcacscsa | 2088 | UGGUGCUAGAUGGAUCAGACAGC | 2473 |
| AD-1727275 | csaaacuuCfacCfAfGfgagccaaaaL96 | 1438 | asUfsuuuUfgcucugGfuAfaguugsgsc | 2089 | AGCAACUUCACAGGAGCCAAAAA | 2476 |
| AD-1727276 | asascuucAfcAfGfGfagccaaaaauL96 | 1439 | asAfsuuuUfggcucuGfguGfaaguusgsc | 2090 | GCAACUUCACAGGAGCCAAAAAG | 2477 |
| AD-1727278 | csusucacAfggAfGfCfcaaaaaguuL96 | 1440 | asAfscuuUfuuggcuCfuGfugaagsusu | 2091 | AACUUCACAGGAGCCAAAAAGUG | 2479 |
| AD-1727285 | gsgsagcCfaAfaAfAfAfgugcuaguuL96 | 1441 | asAfscuaGfacacuuUfuGfgcuccsug | 2092 | CAGGAGCCAAAAAGUGCUAGUC | 2486 |
| AD-1727286 | gsaagccAfaAfAfAfGfugucuagucuL96 | 1442 | asGfsaacuAfgacacuUfuUfggcucscsu | 2093 | AGGAGCCAAAAAGUGUCUAGUCA | 2487 |
| AD-1727288 | gscscaaaAfaGfUfGfucuagucaauL96 | 1443 | asUfsugaCfuagacaCfuUfuggcsusc | 2094 | GAGCCAAAAAGUGUCUAGUCAAC | 2489 |
| AD-1727289 | cscsaaaaAfgUfGfUfCfuagucaacuL96 | 1444 | asGfsuugAfcuagacaCfuUfuuuggscsu | 2095 | AGCCAAAAAGUGUCUAGUCAACU | 2490 |
| AD-1727290 | csaaaaaAfgUfGfUfCfuagacAfcUfuuuugsgsc | 1445 | asAfsguuGfacuagacAfcUfuuuusgsg | 2096 | GCCAAAAAGUGUCUAGUCAACUU | 2491 |
| AD-1727291 | asaaaaagUfgUfCfUfaguacaacuuuL96 | 1446 | asAfsaguUfgacuagaCfaCfuuuusgsg | 2097 | CCAAAAAGUGUCUAGUCAACUUA | 2492 |
| AD-1727292 | asasaaagUfgUfCfUfAfgucaacuuauL96 | 1447 | asUfsaagUfugacuagAfcAfcuuusug | 2098 | CAAAAAGUGUCUAGUCAACUUAA | 2493 |
| AD-1727293 | asasagugUfcUfAfGfucaacuuaauL96 | 1448 | asUfsuaaGfuugacuaGfaCfacuuususu | 2099 | AAAAAGUGUCUAGUCAACUUAAU | 2494 |
| AD-1727298 | gsuscuagUfcAfAfCfuuaauugaguL96 | 1449 | asCfsucaAfuuaaguuGfacCfuagacsasc | 2100 | GUGUCUAGUCAACUUAAUUGAGA | 2499 |
| AD-1727310 | usasauugAfgAfAfGfguggcaaguuL96 | 1450 | asAfscuuGfccaccuuCfuCfaauuasasg | 2101 | CUUAAUUGAGAAGGUGGCAAGUU | 2501 |
| AD-1727318 | asaaggugCfcAfAfGfuauuggugguL96 | 1451 | asAfscacCfauaaacuGfcCfaccuuscsu | 2102 | AGAAGGUGGCAAGUAUGGUGUG | 2505 |

TABLE 3-continued

Modified Sense and Antisense Strand Sequences of Complement Factor B dsRNA Agents

| Duplex Name | Sense Strand Sequence 5' to 3' | SEQ ID NO: | Antisense Strand Sequence 5' to 3' | SEQ ID NO: | mRNA target sequence | SEQ NO: |
|---|---|---|---|---|---|---|
| AD-1727324 | gscsaaguUfaUfGfGfugugaagccuL96 | 1452 | asGfsgcuUfcacaccaUfaAfcuugcscsa | 2103 | UGGCAAGUAUGGUGUGAAGCCA | 2507 |
| AD-1727331 | asusggugUfaGfAfGfccaagauauuL96 | 1453 | asAfsuauCfuuggcuuCfaCfaccausasa | 2104 | UUAUGUGUGAAGCCAAGAUAUG | 2509 |
| AD-1727358 | asasaauuUfgGfGfUfcaaaguguculL96 | 1454 | asGfsacaCfuuuugaccCfaAfauuuusgsg | 2105 | CCAAAAUUGGGUCAAAGUGUCU | 2511 |
| AD-1727359 | asasauuuGfgGfUfCfaaagugucuuL96 | 1455 | asAfsgacAfcuuugaCfcAfaauuususg | 2106 | CAAAAUUGGGUCAAAGUGUCUG | 2512 |
| AD-1727361 | asusuuggGfucUfAfAfagugucugauL96 | 1456 | asUfscagAfcacuuugAfcCfcaaaususu | 2107 | AAAUUUGGGUCAAAGUGUCUGA | 2513 |
| AD-1727392 | gsusaaugCfaGfAfCfugggucacguL96 | 1457 | asCfsgugAfcccaguCfgCfauuacsusg | 2108 | CAGUAAUGCAGACUGGGUCACGA | 2514 |
| AD-1727420 | asasugaaAfuCfAfAfuuauugagauL96 | 1458 | asUfscuuCfauaauugAfuUfucauusgsa | 2109 | UCAAUGAAAUCAAUUAUGAAGAC | 2518 |
| AD-1727427 | uscsaauuAfuGfAfAfgaccacaaguL96 | 1459 | asCfsuugUfggucuucAfuAfauugasusu | 2110 | AAUCAAUUAUGAAGACCACAAGU | 2522 |
| AD-1727428 | csaasauuaUfgAfAfGfAfcCfcacaagusuL96 | 1460 | asAfscuuGfuggucuuCfaUfuaauusug | 2111 | AAUCAAUUAUGAAGACCACAAGU | 2523 |
| AD-1727430 | asusuaugaAfaGfAfcCfcacaaguugauL96 | 1461 | asCfsaacUfugugugcCfuUfucauaasusu | 2112 | CAAUUAUGAAGACCACAAGUUGA | 2525 |
| AD-1727431 | ususaugaAfgAfcCfaCfcaaguugauL96 | 1462 | asUfscaaCfuugugguUfcUfucauaasusu | 2113 | AAUUAUGAAGACCACAAGUUGAA | 2526 |
| AD-1727432 | usasugaaGfaCfCfAfcaaguugauL96 | 1463 | asUfsucaAfcuugugUfcUfucuasasu | 2114 | AUUAUGAAGACCACAAGUUGAAG | 2527 |
| AD-1727433 | asusgaagAfcCfAfCfaaguuugauL96 | 1464 | asCfsuucAfacuugGfuCfuucauasasa | 2115 | UAUGAAGACCACAAGUUGAAGU | 2528 |
| AD-1727434 | usgsaagaCfcAfCfAfAfguugaaguL96 | 1465 | asAfscuuCfaacuugUfgGfucuucasusa | 2116 | AUGAAGACCACAAGUUGAAGUC | 2529 |
| AD-1727435 | gsaasagaCfcAfCfAfAfguugaagucauL96 | 1466 | asGfsacuUfcaacuugUfgGfucuucsasu | 2117 | UGAAGACCACAAGUUGAAGUCA | 2530 |
| AD-1727436 | asasgaccAfcAfAfGfuugaagucauL96 | 1467 | asUfsgacUfucaacuuGfuGfgucuuscsa | 2118 | UGAAGACCACAAGUUGAAGUCAG | 2531 |
| AD-1727441 | csaacaagUfuGfAfAfgucagggacuL96 | 1468 | asGfsuccCfugacuucAfaCfuugugsgsu | 2119 | ACCACAAGUUGAAGUCAGGGACU | 2535 |
| AD-1727442 | ascsaagugUfgAfAfGfucagggacuaL96 | 1469 | asAfsguCfccugacuuCfaAfcuugusgsg | 2120 | CCACAAGUUGAAGUCAGGGACUA | 2536 |
| AD-1727481 | asgggcagUfgUfAfCfagcaugaugaL96 | 1470 | asCfsaaucAfugcuguaCfaCfugccusgsg | 2121 | CCAGGCAGUGUACAGCAUGAUGA | 2544 |
| AD-1727483 | gscsagugUfaCfAfGfcaugaugagL96 | 1471 | asUfsucauCfaucugugUfaCfacugcscsu | 2122 | AGGCAGUGUACAGCAUGAUGAGC | 2545 |
| AD-1727565 | gsauggaUfuGfCfAfcaacaugggL96 | 1472 | asCfscauUfguugugCfaUfccaucsasg | 2123 | CUGAUGGAUUGCACAACAUGGGC | 2548 |
| AD-1727566 | asusggauUfgCfAfCfaacaugggcuL96 | 1473 | asGfscccAfuguuguCfaAfuccaucscsa | 2124 | UGAUGGAUUGCACAACAUGGGCG | 2549 |
| AD-1727568 | gsgsauugCfaCfAfAfcaugggcgguL96 | 1474 | asCfscgcCfcauguugUfgCfaauccsasu | 2125 | AUGGAUUGCACAACAUGGGCGGG | 2551 |
| AD-1727569 | gsasccccAfaUfUfCfuguucauugauL96 | 1475 | asUfscaaUfgacaguaAfuUfggguscsc | 2126 | GGGACCCAAUUACUGUCAUUGAU | 2552 |

TABLE 3-continued

Modified Sense and Antisense Strand Sequences of Complement Factor B dsRNA Agents

| Duplex Name | Sense Strand Sequence 5' to 3' | SEQ ID NO: | Antisense Strand Sequence 5' to 3' | SEQ ID NO: | mRNA target sequence | SEQ NO: |
|---|---|---|---|---|---|---|
| AD-1727570 | ascsccaaUfuAfCfUfgucauugauuL96 | 1476 | asAfsucaAfugacaguAfaUfuggguscsc | 2127 | GGACCCAAUUACUGUCAUUGAUG | 2553 |
| AD-1727572 | cscsaauuAfcUfGfUfcaauugaugau96 | 1477 | asUfscauCfaaugacaGfuAfauuggsgsu | 2128 | ACCCAAUUACUGUCAUUGAUGAG | 2554 |
| AD-1727584 | asusugauGfaGfAfGfUfccggacuuuL96 | 1478 | asAfsaguCfccggaucUfcAfucaausgsa | 2129 | UCAUUGAGAGAUCCGGACUUG | 2558 |
| AD-1727612 | ususggcaAfgGfAfUfcgcaaaacuL96 | 1479 | asGfsuuuUfugcgaucCfuUfgccaasusg | 2130 | CAUUGGCAAGGAUCGCAAAACC | 2559 |
| AD-1727633 | csaasagggAfgGfAfUfuaucuggauuL96 | 1480 | asAfsuccAfgauaaucCfuCfccuugsgsg | 2131 | CCCAAGGGAGGAUUAUCUGGAUG | 2562 |
| AD-1727638 | gsasggauUfauCfUfGfggaugucuauL96 | 1481 | asUfsagaCfauccagaUfaAfuccucscsc | 2132 | GGGAGGAUUAUCUGGAUGUCUAU | 2563 |
| AD-1727639 | asgggauuAfuCfUfGfGfgaugucuauguL96 | 1482 | asAfsuagAfcauccagAfuAfauccuscsc | 2133 | GGAGGAUUAUCUGGAUGUCUAUG | 2564 |
| AD-1727640 | gsgsauuaUfcUfGfGfaugucuauguL96 | 1483 | asCfsauaGfacauccaGfaUfaauccsusc | 2134 | GAGGAUUAUCUGGAUGUCUAUGU | 2565 |
| AD-1727641 | gsasuuauCfugGfAfUfgucuaugugL96 | 1484 | asAfscauAfgacauccAfgGfAfauaucscsu | 2135 | AGGAUUAUCUGGAUGUCUAUGUG | 2566 |
| AD-1727642 | asusuaucUfggGfAfUfgucuaugugL96 | 1485 | asCfsacaUfagacaucCfaGfauauscsc | 2136 | GGAUUAUCUGGAUGUCUAUGUGU | 2567 |
| AD-1727643 | ususuaucUfgaGfAfUfGfucuaugugL96 | 1486 | asAfscacAfuagacauCfcAfgauaasusc | 2137 | GAUUAUCUGGAUGUCUAUGUGUU | 2568 |
| AD-1727644 | usasucugGfauGfUfCfuaugugutL96 | 1487 | asAfsacaCfauagacaCfcAfagauasasu | 2138 | AUUAUCUGGAUGUCUAUGUGUUG | 2569 |
| AD-1727645 | asucuggAfugUfCfUfaugugutuuL96 | 1488 | asAfsaacAfcauagaCfauCfcagausasa | 2139 | UAUCUGGAUGUCUAUGUGUUUG | 2570 |
| AD-1727646 | uscsuggaUfguCfUfaugugutuuguL96 | 1489 | asCfsaaaCfacauagaCfaUfccagasusa | 2140 | UAUCUGGAUGUCUAUGUGUUUGG | 2571 |
| AD-1727663 | asasccaaGfuaGfUfAfAfcaucaaugcuL96 | 1490 | asGfscauUfgauguucAfcUfugguscsa | 2141 | UGAACCAAGUGAACAUCAAUGCU | 2573 |
| AD-1727664 | ascsccaagUfgAfAfCfauaaugcuuL96 | 1491 | asAfsgcaUfugaguguCfaCfuuggsusc | 2142 | GAACCAAGUGAACAUCAAUGCUU | 2574 |
| AD-1727665 | cscscaaguGfaAfCfAfucaaugcuuL96 | 1492 | asAfsagcAfugauguUfcAfcuuggsusu | 2143 | AACCAAGUGAACAUCAAUGCUUU | 2575 |
| AD-1727666 | csasagugAfaCfAfUfcaaugcuuuL96 | 1493 | asAfsaagCfauuguuGfuUfcAfucuugsgsu | 2144 | ACCAAGUGAACAUCAAUGCUUUG | 2576 |
| AD-1727675 | asusccaauGfcUfUfGfggcuuccaaL96 | 1494 | asUfsuggAfagccaaAfgCfcauugausgsu | 2145 | ACAUCAAUGCUUUGGCUUCCAAG | 2577 |
| AD-1727677 | csasaugcUfuUfGfGfCfcuuccaagauL96 | 1495 | asUfscuuGfgaagccaAfaGfcauugsasu | 2146 | AUCAAUGCUUUGGCUUCCAAGAA | 2579 |
| AD-1727685 | usgsgcuuCfcAfAfGfAfaagacaaauL96 | 1496 | asAfsuugUfcuuucuuGfgAfaagccasa | 2147 | UUUGGCUUCCAAGAAAGACAAUG | 2580 |
| AD-1727689 | ususcaagAfaAfGfacaaugagcuL96 | 1497 | asGfscucAfuuguuuUfCfUfuggaasgsc | 2148 | GCUUCCAAGAAAGACAAUGAGCA | 2581 |
| AD-1727690 | uscscaagaAfaAfGfAfcaaugagcauL96 | 1498 | asUfsgcuCfauuguCfuUfUfuuggasasg | 2149 | CUUCCAAGAAAGACAAUGAGCAA | 2582 |
| AD-1727693 | asasgaaaGfaCfAfAfugagcaacauL96 | 1499 | asUfsguuGfcucauuGfUfCfuuucusgsg | 2150 | CCAAGAAAGACAAUGAGCAACAU | 2584 |

TABLE 3-continued

Modified Sense and Antisense Strand Sequences of Complement Factor B dsRNA Agents

| Duplex Name | Sense Strand Sequence 5' to 3' | SEQ ID NO: | Antisense Strand Sequence 5' to 3' | SEQ ID NO: | mRNA target sequence | SEQ ID NO: |
|---|---|---|---|---|---|---|
| AD-1727696 | asasagacAfaUfGfAfgcaacaugUuuL96 | 1500 | asAfscauGfuugcucaUfuGfucuuuscsu | 2151 | AGAAAGACAAUGAGCAACAUGUG | 2585 |
| AD-1727698 | asggacaaUfgAfGfCfaacauguguuuL96 | 1501 | asAfscacAfuguugcuCfaUfugucususu | 2152 | AAAGACAAUGAGCAACAUGUGUU | 2586 |
| AD-1727699 | gsaascaauGfaGfCfAfacaugugUuuL96 | 1502 | asAfsacaCfauguugc UfcAfuugucsusu | 2153 | AAGACAAUGAGCAACAUGUGUUC | 2587 |
| AD-1727700 | ascsaaugAfgCfAfAfcaugugucuL96 | 1503 | asGfsaacAfcauguugCfuCfauuguscsu | 2154 | AGACAAUGAGCAACAUGUGUUCA | 2588 |
| AD-1727701 | csaasaugaGfcAfAfCfaugugucaUL96 | 1504 | asUfsgaaCfacauguGfc Ufcauugsusc | 2155 | GACAAUGAGCAACAUGUGUUCAA | 2589 |
| AD-1727703 | asusgagcAfaCfAfUfgugucaaaUL96 | 1505 | asUfsuugAfacacaugUfuGfucucasusg | 2156 | CAAUGAGCAACAUGUGUUCAAAG | 2590 |
| AD-1727705 | gsaagcaaCfaUfGfUfguucaaagUuL96 | 1506 | asAfscuuUfgaacacaUfgUfugcucsasu | 2157 | AUGAGCAACAUGUGUUCAAAGUC | 2591 |
| AD-1727708 | csasacauGfuGfUfUfcaaagucaUL96 | 1507 | asUfsugaCfuuugacAfcAfugugucsasu | 2158 | AGCAACAUGUGUUCAAAGUCAAG | 2593 |
| AD-1727709 | asaacaugUfgUfUfCfAfacagucaUL96 | 1508 | asCfsuuGfAfcuuugaaCfaCfaugusgsc | 2159 | GCAACAUGUGUUCAAAGUCAAGG | 2594 |
| AD-1727710 | ascsaugugUfCfAfAfagucaaggUL96 | 1509 | asCfscuuGfacuuugaAfcAfcaugususg | 2160 | CAACAUGUGUUCAAAGUCAAGGA | 2595 |
| AD-1727712 | asusgugUfcAfAfAfgucaaggauL96 | 1510 | asAfsuccUfugacuuuGfaAfcacaugsu | 2161 | ACAUGUGUUCAAAGUCAAGGAUA | 2596 |
| AD-1727713 | usgsuguuCfaAfAfGfucaaggauaUL96 | 1511 | asUfsaucCfuugacuuUfgAfacacasug | 2162 | CAUGUGUUCAAAGUCAAGGAUAU | 2597 |
| AD-1727714 | gsusguucAfaAfAfGfUfcaaggauaUL96 | 1512 | asAfsuauCfcuugacuUfuGfaaacsasu | 2163 | AUGUGUUCAAAGUCAAGGAUAUG | 2598 |
| AD-1727717 | ususcaaaGfuCfAfAfGfggauauggauL96 | 1513 | asUfscccaUfauccuugAfcUfuugaascsa | 2164 | UGUUCAAAGUCAAGGAUAUGGAA | 2599 |
| AD-1727718 | uscsaaaagUfcAfAfGfGfauauggauL96 | 1514 | asUfsuccAfuauccuuGfacUfuugasasc | 2165 | GUUCAAAGUCAAGGAUAUGGAAA | 2600 |
| AD-1727821 | usasccgaUfuAfcCfCfacaagcaacuL96 | 1515 | asGfsuugCfuugugguAfaUfcgguasesc | 2166 | GGUACCGAUUACCACAAGCAACC | 2610 |
| AD-1727823 | cscsgauuAfccCfAfcCfaagcaaccauL96 | 1516 | asUfsggUfgcuugugGfuAfauggsusa | 2167 | UACCGAUUACCACAAGCAACCAU | 2611 |
| AD-1727826 | asusuaccAfcAfAfGfcaaccauggL96 | 1517 | asCfscauGfguugcuuGfuGfguaauscsg | 2168 | CGAUUACCACAAGCAACCAUGGC | 2613 |
| AD-1727829 | ascscacaAfgCfAfAfccauggcagL96 | 1518 | asCfsugCfcauggUfuUfgguguscasa | 2169 | UUACCACAAGCAACCAUGGCAGG | 2616 |
| AD-1727883 | usgsgugucCfugGfAfGfuacuuugugcL96 | 1519 | asCfsacaAfaguacuAfgAfcaccascsa | 2170 | UGUGGGUCUGAGUACUUUGUGC | 2625 |
| AD-1727977 | gsaasagcagGfAfAfUfUfccugaauuuL96 | 1520 | asAfsaauuCfaggaauuCfUfgcuucsusu | 2171 | AAGAAGCAGGAAUUCCUGAAUUU | 2629 |
| AD-1727978 | asasgcagGfaAfUfUfccugaauuuuL96 | 1521 | asAfsaauUfccaggaauUfCfcugcuuscsu | 2172 | AGAAGCAGGAAUUCCUGAAUUUU | 2630 |
| AD-1727980 | gscsaggaAfuUfCfCfugaauuuuauL96 | 1522 | asUfsaaaAfuucaggaAfuUfcccugscsu | 2173 | AAGCAGGAAUUCCUGAAUUUUAU | 2631 |
| AD-1727981 | csaaggaaUfuCfCfUfgaauuuauuL96 | 1523 | asAfsuaaAfauuccugAfaUfuccugscsu | 2174 | AGCAGGAAUUCCUGAAUUUUAUG | 2632 |

TABLE 3-continued

Modified Sense and Antisense Strand Sequences of Complement Factor B dsRNA Agents

| Duplex Name | Sense Strand Sequence 5' to 3' | SEQ ID NO: | Antisense Strand Sequence 5' to 3' | SEQ ID NO: | mRNA target sequence | SEQ ID NO: |
|---|---|---|---|---|---|---|
| AD-1727984 | gsasauucCfuGfAfAfuuuuaugacuL96 | 1524 | asGfsucaUfaaaauucAfgGfaauucscsu | 2175 | AGGAAUCCUGAAUUUAUGACU | 2635 |
| AD-1727985 | asasuuccUfgAfAfAfuuuaugacuuL96 | 1525 | asAfsgucAfuaaaauUfaGfgaauuscsc | 2176 | GGAAUCCUGAAUUUAUGACUA | 2636 |
| AD-1727986 | asusuccuGfaAfAfUfUfuuaugacuauL96 | 1526 | asUfsaguCfauaaauUfcAfggaauusc | 2177 | GAAUCCUGAAUUUAUGACUAU | 2637 |
| AD-1727987 | ususccugAfaUfUfUfUfuaugacuauuL96 | 1527 | asAfsuagUfcauaaauUfuCfaggaasusu | 2178 | AAUUCCUGAAUUUAUGACUAUG | 2638 |
| AD-1727989 | cscsugaaUfuUfUfAfugacuaugauL96 | 1528 | asUfscauAfgucauaaAfaUfuccggsasa | 2179 | UUCCUGAAUUUAUGACUAUGAC | 2640 |
| AD-1727990 | csusgaauUfuUfAfUfgacuaugacuL96 | 1529 | asGfsucaUfagucauaAfaUfuucagsgsa | 2180 | UCCUGAAUUUAUGACUAUGACG | 2641 |
| AD-1727992 | gsaauuuUfaUfGfAfcuaugacguL96 | 1530 | asAfscguCfauagucaUfaAfaauucsasg | 2181 | CUGAAUUUAUGACUAUGACGUU | 2642 |
| AD-1727993 | asasuuuuAfuGfAfCfuaugacguugL96 | 1531 | asAfsacgUfcauagucAfuAfaauuscsa | 2182 | UGAAUUUAUGACUAUGACGUUG | 2643 |
| AD-1727994 | asusuuuaUfgAfCfUfaugacguugcL96 | 1532 | asCfsaacGfucauagUfaUfaaauusuc | 2183 | GAAUUUAUGACUAUGACGUUGC | 2644 |
| AD-1727996 | ususuaugAfcUfAfUfgacguugcccuL96 | 1533 | asGfsgcaAfcgucauaGfucFfauaaasasu | 2184 | AUUUAUGACUAUGACGUUGCCC | 2645 |
| AD-1727999 | asusugacuAfuGfAfCfguugcccugaL96 | 1534 | asCfsaggGfcaacgucAfuAfgucausasa | 2185 | UUAUGACUAUGACGUUGCCCGA | 2648 |
| AD-1728049 | csasgacuAfuCfAfGfgcccauuuguL96 | 1535 | asCfsaaaUfgggccugAfuAfgucugsgsc | 2186 | GCCAGACUAUCAGGCCCAUUUGU | 2657 |
| AD-1728050 | asgsgacuaUfcAfGfGfcccauuuguuL96 | 1536 | asAfscaaaUfgggccuGfaUfagucusgsg | 2187 | CCAGACUAUCAGGCCCAUUUGUC | 2658 |
| AD-1728061 | csgsagggAfaCfAfCfucgagcuuuL96 | 1537 | asAfsagcUfcgaguugUfuCfccucgsgsu | 2188 | ACCGAGGGAACACUCGAGCUUU | 2662 |
| AD-1728062 | gsasagggAfaCfAfAfCfcugagcuuuuL96 | 1538 | asAfsaagCfucgaguuGfuUfcccucgsg | 2189 | CCGAGGGAACACUCGAGCUUUG | 2663 |
| AD-1728067 | asascaacUfcGfAfGfcuuuuugaggcuL96 | 1539 | asGfscccUfaaaagcuGfaGfuugusucsc | 2190 | GGAACACUCGAGCUUUGAGGCU | 2666 |
| AD-1728085 | gscsuuccUfcCfAfGfAfcuaccacugL96 | 1540 | asAfsagugGfuaguugGfaGfgaagcscsu | 2191 | AGGCUUCCUCCAACUACCACUG | 2677 |
| AD-1728132 | csusgcacAfgGfAfUfaucaaagcucL96 | 1541 | asAfsgcuUfugauauCfcUfgugcagsgsg | 2192 | CCCUGCACAGGAUAUCAAAGCUC | 2685 |
| AD-1728137 | csasggauAfuCfAfAfagcucuguuuL96 | 1542 | asAfsacaGfagcuuugAfuAfuccugusug | 2193 | CACAGGAUAUCAAAGCUCUGUUU | 2686 |
| AD-1728140 | gsasuaucAfaAfGfCfucuguuuguuL96 | 1543 | asAfscaaAfcagagcuUfuGfauauscscu | 2194 | AGGAUAUCAAAGCUCUGUUUGUG | 2687 |
| AD-1728146 | asasagcuCfuGfUfUfugugucugauL96 | 1544 | asUfscagAfcacaaacAfgAfgcuuusgsa | 2195 | UCAAAGCUCUGUUUGUGUCUGAG | 2688 |
| AD-1728195 | asasgaaaAfgGfCfAfGfcugugagaguL96 | 1545 | asCfsucuCfacacgcCfcUfuucusasau | 2196 | AUAAGAAAGGCAGCUGUGAGAGA | 2696 |
| AD-1728204 | asgscuguGfaGfAfGfAfgaugcucauL96 | 1546 | asUfsgagCfaucucuCfAfcagcusgsc | 2197 | GCAGCUGUGAGAGAUGCUCAA | 2698 |
| AD-1728206 | csusgugaGfaGfAfGfaugcucaauuL96 | 1547 | asAfsuugAfgcaucucUfcAfucacagscsu | 2198 | AGCUGUGAGAGAUGCUCAAUA | 2699 |

TABLE 3-continued

Modified Sense and Antisense Strand Sequences of Complement Factor B dsRNA Agents

| Duplex Name | Sense Strand Sequence 5' to 3' | SEQ ID NO: | Antisense Strand Sequence 5' to 3' | SEQ ID NO: | mRNA target sequence | SEQ ID NO: |
|---|---|---|---|---|---|---|
| AD-1728207 | usgsugagaAfgAfGfAfaugcucaauauL96 | 1548 | asUfsauuGfagcaucUfuCfucacasgsc | 2199 | GCUGUGAGAGAUGCUCAAUAU | 2700 |
| AD-1728208 | gsusgagaGfaGfAfAfUfgcaucaauauuL96 | 1549 | asAfsuauUfgagcaucUfcUfcucacsasg | 2200 | CUGUGAGAGAUGCUCAAUAUG | 2701 |
| AD-1728209 | usgsugagaAfgAfUfGfcucaauauguL96 | 1550 | asCfsauaUfugagcauCfuCfucucaucsa | 2201 | UGUGAGAGAUGCUCAAUAUGC | 2702 |
| AD-1728210 | gsusgagaGfaUfGfCfucaauaugcuL96 | 1551 | asGfscauAfuugagcaUfcUfcucucsasc | 2202 | GUGAGAGAUGCUCAAUAUGCC | 2703 |
| AD-1728212 | csasggcuAfuGfAfCfaaagucaagL96 | 1552 | asCfsuugaAfcuuugucAfuaAfgccugsgg | 2203 | CCCAGGCUAUGACAAAGUCAAGG | 2704 |
| AD-1728214 | gsgscuauGfacfAfAfagucaaggauL96 | 1553 | asUfsccuUfgacuuuguUfcAfuagccsug | 2204 | CAGGCUAUGACAAAGUCAAGGAC | 2706 |
| AD-1728220 | gsascaaaGfucCfAfAfggacaucucuL96 | 1554 | asGfsagaUfgccuugAfcUfuugucsasu | 22056 | AUGACAAAGUCAAGGACAUCUCA | 2707 |
| AD-1728244 | ususguacUfgGfAfGfgagugauucuL96 | 1555 | asGfsacuCfacuccuCfaGfucacaasasg | 2206 | CUUUGUACUGGAGGAGUGAGUCC | 2713 |
| AD-1728258 | asasuacuUfgCfAfGfaggugauucuuL96 | 1556 | asGfsaauCfaccuccUfaCfaAfguauusgsg | 2207 | CCAAUACUUGCAGAGGUGAUUCU | 2722 |
| AD-1728260 | usascuugCfaGfAfGfgugauucuguL96 | 1557 | asCfsagaAfucaccucUfgCfaaguasusu | 2208 | AAUACUUGCAGAGGUGAUUCUGG | 2723 |
| AD-1728269 | usgfsauagUfuCfAfCfaagaagaaguL96 | 1558 | asAfscuuCfucuuguAfacFfuaucasasg | 2209 | CUUGAUAUAGUUCACAAGAAGUC | 2726 |
| AD-1728270 | gsasuaguUfcAfCfAfAfagagaaagucguL96 | 1559 | asGfsacuUfucuuguGfaAfcuaucsasa | 2210 | UUGAUAGUUCACAAGAAGAAGUCG | 2727 |
| AD-1728271 | asuuaguuCfaCfAfAfgagaaagucguL96 | 1560 | asCfsgacUfucuccugUfgAfacuauscsa | 2211 | UGAUAGUUCACAAGAAGAAGUCGU | 2728 |
| AD-1728272 | usasguucAfcAfAfGfagagagucguuL96 | 1561 | asAfscgaCfuucucuugFfuGfaacuasusc | 2212 | GAUAGUUCACAAGAAGAAGUCGUU | 2729 |
| AD-1728273 | asgsuucaAfcAfAfGfaAfagaaguuuL96 | 1562 | asAfsacgAfcuuucucUfgFfgaacusasu | 2213 | AUAGUUCACAAGAAGAAGUCGUUU | 2730 |
| AD-1728274 | gsusucacAfaGfAfAfgaagucguuuL96 | 1563 | asAfsaacGfacuucucUfuGfugaacsusa | 2214 | UAGUUCACAAGAAGAAGUCGUUUC | 2731 |
| AD-1728275 | ususucacAfaGfAfAfaugucguuucuL96 | 1564 | asGfsaaaCfgacuucuCfuUfgugaascsu | 2215 | AGUUCACAAGAAGAAGUCGUUUCA | 2732 |
| AD-1728276 | uscsacacAfgEfAfAfAfgucguuucauL96 | 1565 | asUfsgaaAfcgacuucUfcUfugugasasc | 2216 | GUUCACAAGAAGAAGUCGUUUCAU | 2733 |
| AD-1728277 | csasacaaGfaGfAfAfgfucguuucauuL96 | 1566 | asAfsugaAfacgacuuCfuCfuugugsasa | 2217 | UUCACAAGAAGAAGUCGUUUCAUU | 2734 |
| AD-1728278 | ascsaagaGfaAfGfEfUfgcuuucauuuL96 | 1567 | asAfsaugAfaacgacUfuCfuuugsgsa | 2218 | UCACAAGAAGAAGUCGUUUCAUUC | 2735 |
| AD-1728279 | csasagagAfaGfUfCfguucauucauL96 | 1568 | asGfsaauGfaaacgacUfuCfucucusug | 2219 | CACAAGAAGAAGUCGUUUCAUUCA | 2736 |
| AD-1728280 | asasgagaAfgUfCfGfuuucauucauL96 | 1569 | asUfsgaaUfgaaacgaCfuUfcucuusgsu | 2220 | ACAAGAAGAAGUCGUUUCAUUCAA | 2737 |
| AD-1728282 | gsasagaagUfcGfUfUfucauucaaguL96 | 1570 | asCfsuugAfugaaacGfaCfuucucsusu | 2221 | AAGAGAAGUCGUUUCAUUCAAGU | 2739 |
| AD-1728283 | asgsaaguCfgUfUfUfcauucaaguuL96 | 1571 | asAfscuuGfaaugaaaCfgAfcuucscsu | 2222 | AGAGAAGUCGUUUCAUUCAAGUU | 2740 |

TABLE 3-continued

Modified Sense and Antisense Strand Sequences of Complement Factor B dsRNA Agents

| Duplex Name | Sense Strand Sequence 5' to 3' | SEQ ID NO: | Antisense Strand Sequence 5' to 3' | SEQ ID NO: | mRNA target sequence | SEQ ID NO: |
|---|---|---|---|---|---|---|
| AD-1728284 | gsaasagucGfuUfCfcauucaaguuuL96 | 1572 | asAfsacuUfgaaugaaAfcGfacuucsusc | 2223 | GAGAAGUCGUUUCAUUCAAGUUG | 2741 |
| AD-1728285 | asasgucgUfuUfCfAfuucaaguuuguL96 | 1573 | asCfsaaacUfugaaugaAfaCfgacuuscsu | 2224 | AGAAGUCGUUUCAUUCAAGUUGG | 2742 |
| AD-1728286 | asgsucgUfucCfAfUfUfucaaguugguL96 | 1574 | asCfscaaCfuugaaugAfaAfcgacususc | 2225 | GAAGUCGUUUCAUUCAAGUUGGU | 2743 |
| AD-1728300 | gsasguagUfgGfAfUfGfgucugcaaauL96 | 1575 | asUfsuuugCfagacaucCfacCfuacucscsc | 2226 | GGGAGUAGUGGAUGUCUGCAAAA | 2744 |
| AD-1728301 | asgsuaguGfgAfUfGfGfucugcaaaaUL96 | 1576 | asUfsuuuuGfcagacauCfcAfcuacucsusc | 2227 | GGAGUAGUGGAUGUCUGCAAAAA | 2745 |
| AD-1728302 | gsusuaguGfgAfUfGfUfcugcaaaauUL96 | 1577 | asUfsuuuuUfgcagacaUfcCfacuacsusc | 2228 | GAGUAGUGGAUGUCUGCAAAAAC | 2746 |
| AD-1728303 | usasaguggAfuGfUfCfugcaaaacuUL96 | 1578 | asGfsuuuuUfugcagacAfuCfcacuascsu | 2229 | AGUAGUGGAUGUCUGCAAAAACC | 2747 |
| AD-1728307 | gsgsaugucUfugCfAfaaaaccagauUL96 | 1579 | asAfscugGfuuuuugCfaGfaAfcauccsasc | 2230 | GUGGAUGUCUGCAAAAACCAGAA | 2751 |
| AD-1728308 | gsaaugucUfugCfAfAfaaaaccagaaUL96 | 1580 | asUfsucuGfguuuugCfaGfacaucscsa | 2231 | UGGAUGUCUGCAAAAACCAGAAG | 2752 |
| AD-1728311 | gsuscugcAfaAfAfAfccagaagcgUL96 | 1581 | asCfsgcuUfcugguuUfuGfcagascsa | 2232 | AUGUCUGCAAAAACCAGAAGCGG | 2753 |
| AD-1728312 | uscscugcAfaAfAfCfcagaagcggUL96 | 1582 | asCfscgcUfucugguuUfuUfgcagascsa | 2233 | UGUCUGCAAAAACCAGAAGCGGC | 2754 |
| AD-1728317 | asasaaacCfaGfAfAfgcggcaaaaUL96 | 1583 | asUfsuuuGfccgcuuCfuGfGfuuuusgsc | 2234 | GCAAAAACCAGAAGCGGCAAAAG | 2757 |
| AD-1728318 | asasaaccAfgAfAfGfcggcaaagcUL96 | 1584 | asCfsuuuUfgccgcuuCfuGfgcuuusug | 2235 | CAAAAACCAGAAGCGGCAAAAGC | 2758 |
| AD-1728320 | asascagAfaGfCfGfgcaaaagcauL96 | 1585 | asUfsgcuUfuugcgcUfuCfugguususu | 2236 | AAAAACCAGAAGCGGCAAAAGCAG | 2760 |
| AD-1728324 | asgsaagcCfgCfAfAfaagcaggauL96 | 1586 | asUfsaccUfgcuuugCfccGfcuucusgsg | 2237 | CCAGAAGCGGCAAAAGCAGGUAC | 2761 |
| AD-1728405 | asascuccAfaGfAfUfgaggauuuguL96 | 1587 | asCfsaaaUfccucaucUfuGfgaguususc | 2238 | GAAACUCCAAGAUGAGGAUUUGG | 2765 |
| AD-1728408 | uscscaagAfuGfAfGfgauuuggguUL96 | 1588 | asAfscccAfaauccucAfuCfuuggasgsu | 2239 | ACUCCAAGAUGAGGAUUUGGGUU | 2766 |
| AD-1728410 | csasagauGfaGfGfAfuuuggguuuuL96 | 1589 | asCfsaaaCfcaaauccUfcAfucuugsgsa | 2240 | UCCAAGAUGAGGAUUUGGGUUUU | 2767 |
| AD-1728412 | asgsaugaGfgAfUfUfuggguuuucuL96 | 1590 | asGfsaaaAfcccaaauCfcUfcaucusug | 2241 | CAAGAUGAGGAUUUGGGUUUUCU | 2768 |
| AD-1728422 | gsusgggaUfuGfAfAfuuaaaacagcL96 | 1591 | asUfsuuaauuCfAfUfcccacsgsc | 2242 | GCGUGGGAUUGAAUUAAAACAGC | 2769 |
| AD-1728423 | usgsggauUfgAfAfUfuaaaacagcuL96 | 1592 | asGfscugUfuuuaauuCfAfaUfcccascsg | 2243 | CGUGGGAUUGAAUUAAAACAGCU | 2770 |
| AD-1728424 | gsgsgauuGfaAfUfUfaaaacagcugL96 | 1593 | asAfsgcuGfuuuuaauUfcAfauccscsasc | 2244 | GUGGGAUUGAAUUAAAACAGCUG | 2771 |
| AD-1728427 | asusugaaUfuAfAfAfacacucgcguL96 | 1594 | asCfsgcaGfcuguuuuAfuUfucaauscsc | 2245 | GGAUUGAAUUAAAACAGCUGCGA | 2772 |
| AD-1728447 | asaagggaAfuGfUfGfaccaggucuuL96 | 1595 | asAfsgadc(Tgn)ggucacAfuUfcccuuscsc | 2246 | GGAAGGGAAUGUGACCAGGUCUA | 2385 |

TABLE 3-continued

Modified Sense and Antisense Strand Sequences of Complement Factor B dsRNA Agents

| Duplex Name | Sense Strand Sequence 5' to 3' | SEQ ID NO: | Antisense Strand Sequence 5' to 3' | SEQ ID NO: | mRNA target sequence | SEQ ID NO: |
|---|---|---|---|---|---|---|
| AD-1728461 | asgsgucuAfgGfUfCfuggaguuucuL96 | 1596 | asGfsaadAc(Tgn)ccagacCfuAfgaccusgsg | 2247 | CCAGGUCUAGGUCUGGAGUUUCA | 2391 |
| AD-1728470 | uscsuggaGfuUfUfCfagcuuggacuuL96 | 1597 | asGfsucdCa(Agn)gcugaaAfcUfccagascsc | 2248 | GGUCUGGAGUUUCAGCUUGGACA | 2393 |
| AD-1728471 | csusggagUfuUfCfAfgcuuggacauL96 | 1598 | asUfsgudCc(Agn)agcugaAfaCfuccagsasc | 2249 | GUCUGGAGUUUCAGCUUGGACAC | 2394 |
| AD-1728659 | uscsuucCfgGfCfUfucuacccguuL96 | 1599 | asAfscgdGg(Tgn)agaagcCfaGfaaggascsa | 2250 | UGUCCUUCUGGCCUUCUACCCGUA | 2397 |
| AD-1728664 | csusggcuUfcUfAfCfccguacccuuL96 | 1412 | asAfsggdGu(Agn)cgggtaGfaAfgccagsasa | 2251 | UUCUGGCCUUCUACCCGUACCCUG | 2400 |
| AD-1728671 | csusacccGfuAfCfCfcugugcagauL96 | 1600 | asGfscudGc(Agn)cagggaUfcGfgguagsasa | 2252 | UUCUACCCGUACCCUGUGCAGAC | 2401 |
| AD-1728685 | usgscagaCfaCfGfUfaccugcagauL96 | 1601 | asUfscudGc(Tgn)gguacgUfgUfcugcascsa | 2253 | UGUGCAGACACGUACCUGCAGAU | 2402 |
| AD-1728736 | asasggcaGfaGfUfGfcagagcaauuL96 | 1602 | asAfsuudGc(Tgn)cugcacUfcUfgccuuscsc | 2254 | GGAAGGCAGAGUGCAGAGCAAUC | 2403 |
| AD-1728777 | cscsuacuAfcAfAfUfgugaguagauL96 | 1414 | asAfsucdAc(Tgn)cacauuGfuAfguaggsgsa | 2255 | UCCCUACUACAAUGUGAGUAGAUG | 2407 |
| AD-1728784 | csasaugaGfaGfUfGfaugaugauauL96 | 1417 | asAfsgadTc(Tgn)caucacAfcAfcauugsusa | 2256 | UACAAUGUGAGUGAUGAGAUCUC | 2411 |
| AD-1728786 | asusugagaGfuGfAfUfgagaucucuL96 | 1419 | asAfsgadGa(Tgn)cucaucAfcUfcacausug | 2257 | CAAUGUGAGUGAUGAGAUCUCUU | 2413 |
| AD-1728787 | usgsugagaUfgAfUfGfagaucucuuL96 | 1420 | asAfsagdAg(Tgn)ucucauCfaCfucacascsu | 2258 | AAUGUGAGUGAUGAGAUCUCUUU | 2414 |
| AD-1728789 | usgsagugAfuGfAfGfaucucuuucuL96 | 1422 | asAfsaadAg(Agn)gaucucAfuCfacucascsa | 2259 | UGUGAGUGAUGAGAUCUCUUUCC | 2416 |
| AD-1728793 | usgsaugaGfaUfCfUfcuuuccacuuL96 | 1425 | asAfsgudGg(Agn)aagagaUfcUfcaucascsu | 2260 | AGUGAUGAGAUCUCUUUCCACUG | 2420 |
| AD-1728801 | uscsucuuuUfccCfAfCffugcuagacuuL96 | 1426 | asGfsucdAu(Agn)gcagugGfaAfagagasusc | 2261 | GAUCUCUUUCCACUGCUAUGACG | 2423 |
| AD-1728802 | csuscuuuCfcAfCfUfgcuagacguL96 | 1603 | asCfsgudCa(Tgn)agcaguGfgAfaagagsasu | 2262 | AUCUCUUUCCACUGCUAUGACGG | 2424 |
| AD-1728810 | ascsugcuAfuGfAfCfgguuacacuuL96 | 1427 | asAfsgudGu(Agn)accgucAfuAfgcagusgg | 2263 | CCACUGCUAUGACGGUUACACUC | 2426 |
| AD-1728811 | csusgcuaUfgAfCfGfguuacacucuL96 | 1604 | asGfsagdTg(Tgn)aaccgcUfaUfagcagsug | 2264 | CACUGCUAUGACGGUUACACUCU | 2427 |
| AD-1728827 | uscscgucCfuGfCfCfaagugaauuL96 | 1605 | asCfsaudTc(Agn)cuuggcCfaGfgugcasusu | 2265 | AAUCGACCUGCCAAGUGAAUGG | 2431 |
| AD-1728861 | csasgacaGfcGfAfUfcugugacaauL96 | 1428 | asUfsgudTc(Agn)cagaucGfcUfgucugscsc | 2266 | GGCAGACAGCGAUCUGUGACAAC | 2433 |
| AD-1728863 | gsascagcGfaUfCfUfgugacaacguL96 | 1606 | asCfsgudTg(Tgn)cacagaUfcGfcugucsusg | 2267 | CAGACAGCGAUCUGUGACAACGG | 2435 |
| AD-1728877 | usgsggcaCfaAfGfGfAfaggugggcauL96 | 1607 | asUfsgcdCc(Agn)ccuuccUffuGfugccasasu | 2268 | AUUGGCACAAGGAAGGUGGGCAG | 2439 |
| AD-1728909 | ususugaagAfcAfGfCfgucaccuacuL96 | 1608 | asGfsuadGg(Tgn)gacgcUfuCfuucaasgsg | 2269 | CCUUGAAGACAGCGUCACCUACC | 2442 |
| AD-1728990 | asgsacuccUfuUfCfAfuguacgacauL96 | 1609 | asUfsgudCg(Tgn)acaugaAfgGfagucusug | 2270 | CAAGAGUCCUUCAUGUACGACAC | 2451 |

TABLE 3-continued

Modified Sense and Antisense Strand Sequences of Complement Factor B dsRNA Agents

| Duplex Name | Sense Strand Sequence 5' to 3' | SEQ ID NO: | Antisense Strand Sequence 5' to 3' | SEQ ID NO: | mRNA target sequence | SEQ ID NO: |
|---|---|---|---|---|---|---|
| AD-1728995 | csaasagagGfuaGfCfCfcgaagcuuuuL96 | 1610 | asAfsaadGc(Tgn)ucggccAfcCfucuugsasg | 2271 | CUCAAGAGGUGCCGAAGCUUUC | 2453 |
| AD-1729031 | gsasgaccAfuAfGfAfaggagucgauL96 | 1611 | asUfscgdAc(Tgn)ccuucuAfuGfgucucsusg | 2272 | CAGAGACCAUAGAAGAGUCGAU | 2456 |
| AD-1729089 | csaasggcuCfcAfUfGfaacaucuacuL96 | 1612 | asGfsuadGa(Tgn)guucaaGfgAfgccugsasa | 2273 | UUCAGGCUCCAUGAACAUCUACC | 2462 |
| AD-1729103 | asuscuacCfuGfGfUfgcuagaugguL96 | 1613 | asCfscadTc(Tgn)agcaccAfgGfuagausgsu | 2274 | ACAUCUACCUGGUGCUAGAUGGA | 2466 |
| AD-1729105 | csusaccugGfuGfCfCfuagaugauuL96 | 1614 | asAfsucdCa(Tgn)cuagcaCfcAfgguagsasu | 2275 | AUCUACCUGGUGCUAGAUGGAUC | 2468 |
| AD-1729106 | usasccugGfuGfCfUfagaugGaucuL96 | 1615 | asGfsaudCc(Agn)ucuagcAfcCfagguasgsa | 2276 | UCUACCUGGUGCUAGAUGGAUCA | 2469 |
| AD-1729110 | usgsggugcUfaGfAfUfgaucagacuL96 | 1436 | asGfsucdTg(Agn)uccaucUfaGfccaccasgsg | 2277 | CCUGGUGCUAGAUGGAUCAGACA | 2472 |
| AD-1729112 | gsusgcuaGfaUfGfGfaucagacagL96 | 1437 | asCfsugdTc(Tgn)gauccaUfcUfagcacscsa | 2278 | UGGUGCUAGAUGGAUCAGACAGC | 2473 |
| AD-1729130 | csaascaggAfgCfCfcAfaaaaguucuL96 | 1616 | asGfsacdCa(Agn)uuuuggCfucUfccugugsasa | 2279 | UUCACAGGAGCCAAAAAGUGUCU | 2482 |
| AD-1729132 | csaasggagCfcAfAfAfAfaaguucuagL96 | 1617 | asUfsagdAc(Agn)cuuuuuGfgCfucccugsug | 2280 | CACAGGAGCCAAAAAGUGUCUAG | 2484 |
| AD-1729134 | gsgsagccCfaAfaAfAfAfgugucuagcL96 | 1441 | asCfscudAc(Agn)cuuuuuUfuGfgcuccsusg | 2281 | CAGGAGCCAAAAAGUGUCUAGUC | 2486 |
| AD-1729136 | asgscccaaAfaAfGfUfgucuagucaL96 | 1618 | asUfsgadCu(Agn)gacacuUfuUfuggcucscsc | 2282 | GGAGCCAAAAAGUGUCUAGUCAA | 2488 |
| AD-1729137 | gscscccaaaAfaGfUfGfucuagucaacL96 | 1443 | asUfsugdAc(Agn)agacacUfuUfuugcsusc | 2283 | GAGCCAAAAAGUGUCUAGUCAAC | 2489 |
| AD-1729139 | csaaAfaAfaGfUfGfUfCfuagucaacuuL96 | 1445 | asAfsgudTg(Agn)cuagacAfcUfuuuugsgsc | 2284 | GCCAAAAAGUGUCUAGUCAACUU | 2491 |
| AD-1729141 | asaaaaguGfuCfUfAfGfucaacuuauL96 | 1447 | asUfsaadGu(Tgn)gacuagAfcAfcuuuusug | 2285 | CAAAAAGUGUCUAGUCAACUUAA | 2493 |
| AD-1729142 | asasagugUfcUfAfGfUfcaacuuaauL96 | 1448 | asUfsuadAg(Tgn)ugacuaGfaCfacuuususu | 2286 | AAAAAGUGUCUAGUCAACUUAAU | 2494 |
| AD-1729151 | asgsucaaCfuUfAfAfuugagaagguL96 | 1619 | asCfscudTc(Tgn)caauuaAfgUfugacusasg | 2287 | CUAGUCAACUUAAUUGAGAAGGU | 2500 |
| AD-1729180 | asusggugAfgAfGfCfcaagauauugL96 | 1453 | asAfsuadTc(Tgn)uggcuuCfaCfaccausasa | 2288 | UUAUGGUGAGCCAAGAUAUG | 2509 |
| AD-1729207 | asaaaauUfgGfGfUfcaaagugucuL96 | 1454 | asGfsacdAc(Tgn)uugaccCfaAfauuusgsg | 2289 | CCAAAAUUUGGGUCAAAGUGUCU | 2511 |
| AD-1729242 | usasaugcAfgAfCfUfgggucacgaL96 | 1620 | asUfscgdTg(Tgn)cccagucfuGfcauuascsu | 2290 | AGUAAUGCAGACUGGGUCACGAA | 2515 |
| AD-1729269 | asasugaaAfuCfAfAfuuaugaagacL96 | 1458 | asUfscudTc(Tgn)uaauugAfuUfucauusgsa | 2291 | UCAAUGAAAUCAAUUAUGAAGAC | 2518 |
| AD-1729271 | usgsaaaUfCfaAfUfUfaugaagaccuL96 | 1621 | asGfsgudCu(Tgn)cauauuUfgAfuuucasusu | 2292 | AAUGAAAUCAAUUAUGAAGACCA | 2519 |
| AD-1729274 | asasucaaUfuAfUfGfaagaccacaL96 | 1622 | asUfsgudGg(Tgn)cuucauAfaUfugauususc | 2293 | GAAAUCAAUUAUGAAGACCACAA | 2520 |
| AD-1729277 | csaasauuaUfgAfAfGfaccacaaguuL96 | 1460 | asAfscudTg(Tgn)gguucuCfaAfaauugsasu | 2294 | AUCAAUUAUGAAGACCACAAGUU | 2523 |

TABLE 3-continued

Modified Sense and Antisense Strand Sequences of Complement Factor B dsRNA Agents

| Duplex Name | Sense Strand Sequence 5' to 3' | SEQ ID NO: | Antisense Strand Sequence 5' to 3' | SEQ ID NO: | mRNA target sequence | SEQ ID NO: |
|---|---|---|---|---|---|---|
| AD-1729280 | ususaugaAfgAfCfCfacaaguugauL96 | 1462 | asUfscadAc(Tgn)uguggCfuUfcauaasusu | 2295 | AAUUAUGAAGACCACAAGUUGAA | 2526 |
| AD-1729285 | asasgaccAfcAfAfGfuugaagucauL96 | 1467 | asUfsgadCu(Tgn)caacuuGfuGfgucuuscsa | 2296 | UGAAGACCACAAGUUGAAGUCAG | 2531 |
| AD-1729288 | ascscacaAfgUfUfGfaagucagggaL96 | 1623 | asCfsccdTg(Agn)cuucaaCfuUfguguguscsu | 2297 | AGACCACAAGUUGAAGUCAGGGA | 2533 |
| AD-1729290 | csascaagUfuGfAfAfgucaggacuL96 | 1468 | asGfsuudCc(Tgn)gacuucAfaCfuugugsgsu | 2298 | ACCACAAGUUGAAGUCAGGGACU | 2535 |
| AD-1729296 | ususgaagUfcAfGfGfgacuaacacuL96 | 1624 | asGfsgudTu(Agn)gucccuGfaCfuucaascsu | 2299 | AGUUGAAGUCAGGGACUAACACC | 2538 |
| AD-1729297 | usgfsaaguCfaGfGfGfacuaacaccuL96 | 1625 | asGfsgudGu(Tgn)agucccUfgAfcuuacasasc | 2300 | GUUGAAGUCAGGGACUAACACCA | 2539 |
| AD-1729300 | asgucagGfgAfCfUfaacaccaaguL96 | 1626 | asCfsuudGg(Tgn)guuaguCfcCfugacusususc | 2301 | GAAGUCAGGGACUAACACCAAGA | 2540 |
| AD-1729413 | usgsauggAfuUfGfCfcacaacauguL96 | 1627 | asCfscadTg(Tgn)uugcaAfuCfccaucasgsu | 2302 | ACUGAUGGGAUUGCACAACAUGGG | 2547 |
| AD-1729461 | ususggcaAfgGfAfUfcgcaaaaacuL96 | 1479 | asGfsuudTu(Tgn)gcgaucCfuUfgccaasusg | 2303 | CAUUGGCAAGGAUCGCAAAAACC | 2559 |
| AD-1729462 | usgsgcaaGfgAfUfCfgcaaaaacccuL96 | 1628 | asGfsgudTu(Tgn)ugcgauCfcUfugccasasu | 2304 | AUUGGCAAGGAUCGCAAAAACCC | 2560 |
| AD-1729463 | gsgsgcaaGfgAfUfCfgfgcaaaaacccuL96 | 1629 | asGfsggdTu(Tgn)uugcgaUfcCfuugccsasa | 2305 | UGGGCAAGGAUCGCAAAAACCCA | 2561 |
| AD-1729487 | gsasggauUfaUfCfUfUfggaugcauauL96 | 1481 | asUfsagdAc(Tgn)uccagaUfaAfuucucscsc | 2306 | GGGAGGAUUAUCUGGAUGCUCUAU | 2563 |
| AD-1729514 | cscsaaguGfaAfCfAfucaaugcuuuL96 | 1492 | asAfsagdCa(Tgn)ugauguUfcAfcuuggsusu | 2307 | AACCAAGUGAACAUCAAUGCUUU | 2575 |
| AD-1729515 | csasaguGfaAfCfAfUfCfaaugcuuugL96 | 1630 | asAfsaadGc(Agn)uugaugUfuCfacuugsgsu | 2308 | ACCAAGUGAACAUCAAUGCUUUG | 2576 |
| AD-1729524 | asuscaauGfcUfUfGfUfgcuuccaagaL96 | 1494 | asUfsugdGa(Agn)gccaaaGfcAfuugasusgsu | 2309 | ACAUCAAUGCUUUGGCUUCCAAG | 2577 |
| AD-1729525 | uscsaaugCfuUfUfGfgcuuccaagauL96 | 1630 | asCfsuudGg(Tgn)agcaaAfgCfauugasasg | 2310 | CAUCAAUGCUUUGGCUUCCAAGA | 2578 |
| AD-1729538 | ususccaaGfaAfAfGfacaaugagcaL96 | 1497 | asUfscudCa(Tgn)ugucuuUfcUfuggaasgsc | 2311 | GCUUCCAAGAAAGACAAUGAGCA | 2581 |
| AD-1729539 | uscsccaaGfaAfAfGfAfcaaugcauL96 | 1498 | asUfsgcdTc(Agn)uugucuUffuCfuggaasag | 2312 | CUUCCAAGAAAGACAAUGAGCAA | 2582 |
| AD-1729541 | csasagaaAfgAfCfAfaugagcaacaaL96 | 1631 | asGfsuudGc(Agn)cauugUfcUfucuugsgsa | 2313 | UCCAAGAAAGACAAUGAGCAACA | 2583 |
| AD-1729545 | asasagaCfaAfUfGfAfgcaacaugsuL96 | 1500 | asAfscadTg(Tgn)ugcucaUfuGfucuuusucsu | 2314 | AGAAAGACAAUGAGCAACAUGUG | 2585 |
| AD-1729548 | gsasscaaUfgAfGfCfAfacaugusuuL96 | 1502 | asAfsacdAc(Agn)uguugCfcAfuugucsusu | 2315 | AAGACAAUGAGCAACAUGUGUUC | 2587 |
| AD-1729550 | csasaugaGfcAfAfCfaugugguucaaL96 | 1504 | asUfsgadAc(Tgn)cauguGfcAfauugucsusc | 2316 | GACAAUGAGCAACAUGUGUUCAA | 2589 |
| AD-1729552 | asusagagCfaAfCfAfUfgfguguucaasagL96 | 1505 | asUfsuudGa(Agn)cacaugUfgUfcucaususg | 2317 | CAAUGAGCAACAUGUGUUCAAAG | 2590 |
| AD-1729555 | asgscaacAfuGfUfGfuucaaagucuL96 | 1632 | asGfsacdTu(Tgn)gaacaCfAfuUfguugcuscsa | 2318 | UGAGCAACAUGUGUUCAAAGUCA | 2592 |

TABLE 3-continued

Modified Sense and Antisense Strand Sequences of Complement Factor B dsRNA Agents

| Duplex Name | Sense Strand Sequence 5' to 3' | SEQ ID NO: | Antisense Strand Sequence 5' to 3' | SEQ ID NO: | mRNA target sequence | SEQ ID NO: |
|---|---|---|---|---|---|---|
| AD-1729557 | csasacauGfuGfUfUfcaaagucaauL96 | 1507 | asUfsugdAc(Tgn)uugaacAfcAfuguugscsu | 2319 | AGCAACAUGUGUUCAAAGUCAAG | 2593 |
| AD-1729559 | ascsaugugUfcAfAfaagucaagguL96 | 1509 | asCfsgcudTg(Agn)cuuugaAfcAfcaugusug | 2320 | CAACAUGUGUUCAAAGUCAAGGA | 2595 |
| AD-1729561 | asusuguguUfcAfAfAfgucaaggauuL96 | 1510 | asAfsucdCu(Tgn)gacuuuGfaAfcacausgsu | 2321 | ACAUGUGUUCAAAGUCAAGGAUA | 2596 |
| AD-1729562 | usguguguuCfaAfAfGfucaaggauauL96 | 1511 | asUfsaudCc(Tgn)ugacuuUfgAfacacausug | 2322 | CAUGUGUUCAAAGUCAAGGAUAU | 2597 |
| AD-1729567 | uscsaaagUfcAfAfGfgauaugaauL96 | 1514 | asUfsuudCa(Tgn)auccuuGfaCfuuugasasc | 2323 | GUUCAAAGUCAAGGAUAUGGAAA | 2600 |
| AD-1729568 | csaasaaguCfaAfGfGfauauggaaauL96 | 1633 | asUfsuudCc(Agn)uauccuUfgAfcuuugsasa | 2324 | UUCAAAGUCAAGGAUAUGGAAAA | 2601 |
| AD-1729619 | usgsaaagcUfcAfGfUfcucugaguL96 | 1634 | asGfsacdTc(Agn)gagacuGfgCfuuucasusc | 2325 | GAUGAAAGCCAGUCUCUGAGUCU | 2602 |
| AD-1729643 | usgsgcaugGfuUfUfUfgggaacacauL96 | 1635 | asUfsgudGu(Tgn)cccaaaCfcAfugccascsa | 2326 | UGUGGCAUGGUUUUGGGAACACA | 2607 |
| AD-1729667 | gsgsgguacCfgAfUfUfaccacagcaL96 | 1636 | asGfscudTg(Tgn)gguaauCfgGfuacccsusu | 2327 | AAGGGUACCGAUUACCACAAGCA | 2609 |
| AD-1729670 | usasccgauUfaAfCfCfacaagcaacL96 | 1515 | asGfsuudGu(Tgn)uggguaAfuCfgguascsc | 2328 | GGUACCGAUUACCACAAGCAACC | 2610 |
| AD-1729673 | csgsauuaAfcAfAfGfCfAfaccaucauL96 | 1637 | asAfsugdGu(Tgn)gcuuguGfgUfaaucgsgsu | 2329 | ACCGAUUACCACAAGCAACCAUG | 2612 |
| AD-1729677 | usasccacAfaGfCfAfaccauggcaL96 | 1638 | asGfsgcdGa(Tgn)gguugcUfuGfuggusasu | 2330 | AUUACCACAAGCAACCAUGGCAG | 2615 |
| AD-1729688 | ascccaugGfcAfGfGfccaagaucucL96 | 1639 | asAfsgadTc(Agn)uggccuGfcCfaugsusug | 2331 | CAACCAUGGCAGGCCAAGAUCUC | 2618 |
| AD-1729690 | csasuggCfAfgGfCfCfaagaucauL96 | 1640 | asUfsgadGa(Tgn)cuuggcCfuGfccaugsgsu | 2332 | ACCAUGGCAGGCCAAGAUCUCAG | 2620 |
| AD-1729729 | csusguggUfgUfCfUfgagauaguaL96 | 1641 | asAfsaadGu(Agn)cucagaCfaCfcacagscsc | 2333 | GGCUGUGGUCUGAGUACUUUG | 2622 |
| AD-1729802 | asgscgggAfcCfUfGfgagauagaauL96 | 1642 | asUfsucdTa(Tgn)cuccagGfuCfccgcusus | 2334 | GAAGCGGACCUGGAGAUAGAAG | 2628 |
| AD-1729841 | gsaaagcaGfgAfAfUfUfuccugaauuL96 | 1520 | asAfsaudTc(Agn)ggaauuCfcUfgcuucsusu | 2335 | AAGAAGCAGGAAUUCCUGAAUUU | 2629 |
| AD-1729849 | asaauuccUfgAfAfUfuuauugacuaL96 | 1525 | asAfsgudCa(Tgn)aaaauuCfaGfgaauuscsc | 2336 | GGAAUUCCUGAAUUUAUGACUA | 2636 |
| AD-1729850 | asusuccUfgAfAfUfuuauugacauL96 | 1526 | asUfsagdTc(Agn)uaaaauUfcAfggaasusuc | 2337 | GAAUUCCUGAAUUUAUGACUAU | 2637 |
| AD-1729852 | uscscugaAfuUfUfUfaugacuaguL96 | 1643 | asCfsaudAg(Tgn)cauaaaAfuUfcaggasasu | 2338 | AUUCCUGAAUUUAUGACUAUGA | 2639 |
| AD-1729854 | csusgaauUfuAfUfGfgacuagacgL96 | 1529 | asGfsucdAu(Agn)gucauaAfauucagsgsa | 2339 | UCCUGAAUUUAUGACUAUGACG | 2641 |
| AD-1729856 | gsaauuuAfUfGfAfcuaugacguuL96 | 1530 | asAfscgdTc(Agn)uagucaAfuafaauucsasg | 2340 | CUGAAUUUAUGACUAUGACGUU | 2642 |
| AD-1729861 | ususaugaCfuAfUfGfacguugcccuL96 | 1644 | asGfsggdCa(Agn)cgucauAfgUfcauaasasa | 2341 | UUUAUGACUAUGACGUUGCCCU | 2646 |
| AD-1729862 | usasugacUfaUfGfAfcguugcccuL96 | 1645 | asAfsggdGc(Agn)acgucaUfaGfucauauasa | 2342 | UUUAUGACUAUGACGUUGCCCUG | 2647 |

TABLE 3-continued

Modified Sense and Antisense Strand Sequences of Complement Factor B dsRNA Agents

| Duplex Name | Sense Strand Sequence 5' to 3' | SEQ ID NO: | Antisense Strand Sequence 5' to 3' | SEQ ID NO: | mRNA target sequence | SEQ ID NO: |
|---|---|---|---|---|---|---|
| AD-1729869 | asusgacgUfuGfCfCfcugaucaaguL96 | 1646 | asCfsuudGa(Tgn)cagggcAfaCfgucausasg | 2343 | CUAUGACGUUGCCCUGAUCAAGC | 2651 |
| AD-1729870 | usgsacguUfgcCfCfCfugaucaagcuL96 | 1647 | asGfscudTg(Agn)ucagggCfaAfcgucasusa | 2344 | UAUGACGUUGCCCUGAUCAAGCU | 2652 |
| AD-1729872 | ascsguugCfccCfUfGfaucaagcucuL96 | 1648 | asGfsagdCu(Tgn)gaucagGfgCfaacguscsa | 2345 | UGACGUUGCCCUGAUCAAGCUCA | 2654 |
| AD-1729926 | gsasgggaAfcAfAfCfucgagcuuuuL96 | 1538 | asAfsaadGc(Tgn)cgaguuGfuUfcccucsgsg | 2346 | CCGAGGGAACAACUCGAGCUUUG | 2663 |
| AD-1729933 | csaasacucGfaGfCfUfuugaggcuuuL96 | 1649 | asAfsagdCc(Tgn)caaagcUfcCfaguugsusu | 2347 | AACAACUCGAGCUUUGAGGCUUC | 2667 |
| AD-1729941 | gscsuuugAfgGfCfUfuccuccaacuL96 | 1650 | asGfsuudGg(Agn)ggaagcCfuCfaaagcsusc | 2348 | GAGCUUUGAGGCUUCCUCCAACU | 2672 |
| AD-1729947 | asggscuuCfcUfCfCfaacuacacuL96 | 1651 | asGfsugdGu(Agn)guuggaGfgAfagccuscsa | 2349 | UGAGGCUUCCUCCAACUACCACC | 2676 |
| AD-1729951 | ususcuucCfaAfCfUfaccacuugcuL96 | 1652 | asGfscadAg(Tgn)gguaguUfgGfaggaasgsc | 2350 | GCUUCCUCCAACUACCACUGCC | 2678 |
| AD-1729992 | csusccugCfcAfCfAfgfgauaucaauL96 | 1653 | asUfsugdAu(Agn)uccuguGfcAfggagscsa | 2351 | UGCUCCCCUGCACAGGAUAUCAAA | 2682 |
| AD-1729993 | uscsccugCfaCfAfGfGfauaucaaaUL96 | 1654 | asUfsuudGa(Agn)auccugUfgCfaggasgsc | 2352 | GCUCCCCUGCACAGGAUAUCAAAG | 2683 |
| AD-1729994 | csCsccugCfaCfAfGfGfauaucaaagUL96 | 1655 | asCfsuudTg(Tgn)uauccUfgUfgCfaggsasg | 2353 | CUCCCCUGCACAGGAUAUCAAAGC | 2684 |
| AD-1729996 | csusgcacAfgGfAfUfaucaaagcuuL96 | 1541 | asAfsgcdTu(Tgn)gauauccfuGfugcagsgsg | 2354 | CCCUGCACAGGAUAUCAAAGCUC | 2685 |
| AD-1730001 | csasggauAfuCfAfAfagcucuguuuL96 | 1658 | asAfsacdAg(Agn)gcuuugAfuAfuccugsusg | 2355 | CACAGGAUAUCAAAGCUCUGUUU | 2686 |
| AD-1730042 | gscsugaCfUfcGfGfAfAfggaggucuaL96 | 1656 | asAfsgadCc(Tgn)ccuuccGfaGfucagcsusu | 2356 | AAGCUGACUCGGAAGGAGGUCUA | 2689 |
| AD-1730048 | uscsggaaGfgAfGfAfGfGfucuacauaauL96 | 1657 | asUfsugdTg(Agn)agaccuCfcUfuccgasgsu | 2357 | ACUCGGAAGGAGAGUCUACAUCAA | 2692 |
| AD-1730053 | asgsgaggUfcUfAfCfAfucaagaauL96 | 1658 | asUfsuudCu(Tgn)gauguaGfaCfcuccususc | 2358 | GAAGGAGAGUCUACAUCAAGAAUG | 2695 |
| AD-1730059 | asasgaaaGfcCfAfGfCfugugagaAUcuaaL96 | 1545 | asCfsucdTc(Agn)cagcugCfcUfuucuusasu | 2359 | AUAAGAAGGCAGCUGUGAGAGA | 2696 |
| AD-1730068 | asgscuGfAfGfAfGfaugcucuaaL96 | 1546 | asUfsgadGc(Agn)ucucucCfaGfcagcugsc | 2360 | GCAGCUGAGAGAGAUGCUCAA | 2698 |
| AD-1730071 | usgsgagAfgAfGfAfugcucaauauL96 | 1548 | asUfsaudTg(Agn)gcaucuCfuCfucacasgsc | 2361 | GCUGAGAGAGAUGCUCAAUAU | 2700 |
| AD-1730077 | asgsgcuaUfgAfCfAfAfagucaagguuL96 | 1659 | asCfscudTg(Agn)cuuuguCfaUfagccusgsg | 2362 | CCAGGCUAUGACAAAGUCAAGGA | 2705 |
| AD-1730103 | ususccuuUfgUfAfCfUfggaggaguuL96 | 1660 | asAfscudTc(Agn)ccaguaCfaAfaggaascsc | 2363 | GGUUCCUUUGUACUGGAGGAGUG | 2711 |
| AD-1730108 | ususguacUfgGfAfGfGfgaguaguccuL96 | 1555 | asGfsacdTc(Agn)cucuccCfaGfuacaasasg | 2364 | CUUUGUACUGGAGGAGUGAGUCC | 2713 |
| AD-1730110 | gsusacugGfaGfGfAfgugagucccuL96 | 1661 | asGfsggdAc(Tgn)cacuccCfaGfuacacsasa | 2365 | UUGUACUGGAGGAGUGAGUCCCU | 52715 |
| AD-1730112 | ascsuggaGfaGfFGfAfUfgagugucccuauL96 | 1662 | asUfsagdGg(Agn)cucacuCfCfccagusasc | 2366 | GUACUGGAGGAGUGAGUCCCUAU | 2716 |

TABLE 3-continued

Modified Sense and Antisense Strand Sequences of Complement Factor B dsRNA Agents

| Duplex Name | Sense Strand Sequence 5' to 3' | SEQ ID NO: | Antisense Strand Sequence 5' to 3' | SEQ ID NO: | mRNA target sequence | SEQ NO: |
|---|---|---|---|---|---|---|
| AD-1730118 | gsgsagugAfgUfCfCfcuaugcugauL96 | 1663 | asUfscadGc(Agn)uaggacCfuCfacuccsusc | 2367 | GAGGAGUGAGUCCCUAUGCUGAC | 2719 |
| AD-1730122 | asasuacuUfgCfAfGfaggugauucuL96 | 1556 | asGfsaaadTc(Agn)cucucugCfaAfguauusgsg | 2368 | CCAAUACUUGCAGAGGUGAUUCU | 2722 |
| AD-1730133 | usgsauagUfuCfAfCfaagagaaguuL96 | 1558 | asAfscudTc(Tgn)cuugugAfaCfuaucasasg | 2369 | CUUGAUAGUUCACAAGAGAAGUC | 2726 |
| AD-1730143 | csasagagAfaGfUfCfguuucauucuL96 | 1568 | asGfsaaadTg(Agn)aacgacUfuCfucuugsusg | 2370 | CACAAGAGAAGUCGUUUCAUUCA | 2736 |
| AD-1730164 | gsaaguagUfgGfAfUfgucugcaaauL96 | 1575 | asUfsuudGc(Agn)gacaucCfaCfuacucscsc | 2371 | GGGAGUGGAUGUCUGCAAAA | 2744 |
| AD-1730167 | usasguggAfuGfUfCfugcaaaaaccL96 | 1578 | asGfsuudTu(Tgn)gcagacAfuCfcacuascsu | 2372 | AGUAGUGGAUGUCUGCAAAAACC | 2747 |
| AD-1730168 | asgsuggaUfgUfCfUfgcaaaaaccauL96 | 1664 | asGfsgudTu(Tgn)ugcagaCfaUfccacusasc | 2373 | GUAGUGGAUGUCUGCAAAAACCA | 2748 |
| AD-1730169 | gsusguauUfuCfUfGfCfcaaaaaccauL96 | 1665 | asUfsggdTu(Tgn)uugcagAfcAfuccacsusa | 2374 | UAGUGGAUGUCUGCAAAAACCAG | 2749 |
| AD-1730171 | gsgsaugucUfugGfCfaAfGfCfggcaaagcuL96 | 1579 | asUfscudGg(Tgn)uuuugcAfgAfcauccsasc | 2375 | GUGGAUGUCUGCAAAAACCAGAA | 2751 |
| AD-1730183 | asasaccagAfaGfCfCfggcaaagcuL96 | 1666 | asUfscudTu(Tgn)gccgcuUfcUfgguuususu | 2376 | AAAACCAGAAGCGGCAAAAGCA | 2759 |
| AD-1730184 | asasaccagAfaGfCfGfgcaaagcauL96 | 1667 | asUfsgcdTu(Tgn)ugccgcUfuCfuggususu | 2377 | AAAACCAGAAGCGGCAAAAGCAG | 2760 |
| AD-1730256 | usgsgcugAfgGfGfAfgaaacuccauL96 | 1592 | asUfsggdAg(Tgn)uucucuUfCfagccasgsg | 2378 | CCUGGCUGAAGGAGAAACUCCAA | 2764 |
| AD-1730287 | usgsggauUfgAfAfUfaaaacagcuL96 | 1593 | asGfscudGu(Tgn)uuaauuCfaAfuccascsg | 2379 | CGUGGGAUUGAAUUAAAACAGCU | 2770 |
| AD-1730288 | gsgsgauuGfaAfUfUfaaaacagcuuL96 | 1668 | asAfsgcdTg(Tgn)uuuaauUfcAfauucasasu | 2380 | GUGGGAUUGAAUUAAAACAGCUG | 2771 |
| AD-1730293 | usgsaauuAfaAfAfCfagcugcgacuL96 | 1669 | asGfsucdGc(Agn)gcuguuUfuAfauucasasu | 2381 | AUUGAAUUAAAACAGCUGCGACA | 2774 |
| AD-1730476 | asasuaaaAfaCfAfGfcugcgacaauL96 | 1670 | asUfsugcUfgcagcugUfuUfuaauuscsa | 2382 | UGAAUUAAAACAGCUGCGACAAC | 2776 |
| AD-1730477 | asasuuaaaCfAfGfCfugcgacaauL96 | 1670 | asdTsugdTcdGcagedTgUfuuuaauuscsa | 2383 | UGAAUUAAAACAGCUGCGACAAC | 2776 |
| AD-1730478 | asususuaaacAfGfCfugcgacaacuL96 | 1671 | asdGsuuddGudCgcagdCuGfuuuuaausus | 2384 | GAAUUAAAACAGCUGCGACAACA | 2777 |

Example 2. In Vitro Screening Methods

Cell Culture and Transfections:

Transfection assays were carried out in primary human hepatocytes (PHH, BioIVT). Transfection was performed by adding of 5 μl Opti-MEM plus 0.1 μl of Lipofectamine RNAiMax per well (Invitrogen, Carlsbad CA cat #13778-150) to 5 μl of siRNA duplexes per well into a 384-well plate and incubated at room temperature for 15 minutes. 40 μl of in Invitrogro CP media (BioIVT, Cat #Z99029) containing ~10×10³ cells were then added to the siRNA mixture. Cells were incubated for 24 hours prior to RNA purification. Experiments were performed at 10 nM, 1 nM, and 0.1 nM. Total RNA Isolation Using DYNABEADS mRNA Isolation Kit:

RNA was isolated using an Highres Biosolution integration system using Dynabeads™ mRNA DIRECT™ Purification Kit (Invitrogen™, Catalog No. 61012). Briefly, 70 μL of Lysis/Binding Buffer and 10 μL of lysis buffer containing 3 μL of magnetic beads were added to the plate with cells. Plates were incubated on an electromagnetic shaker for 10 minutes at room temperature and then magnetic beads were captured and the supernatant was removed. Bead-bound RNA was then washed 2 times with 90 μL Wash Buffer A and once with 90 μL Wash Buffer B. Beads were then washed with 90 μL Elution Buffer, re-captured, and supernatant was removed. Complementary DNA (cDNA) was synthesized using High-Capacity cDNA Reverse Transcription Kit with RNase Inhibitor (Applied Biosystems™, Catalog No. 4374967) according to the manufacturer's recommendations. A master mix containing 1 μL 10× Buffer, 0.4 μL 25× deoxyribonucleotide triphosphate, 1 μL 10× Random primers, 0.5 μL Reverse Transcriptase, 0.5 μL RNase inhibitor, and 6.6 μL of H₂O per reaction was added to RNA isolated above. The plates were sealed, mixed, and incubated on an electromagnetic shaker for 10 minutes at room temperature, followed by 2 hours incubation at 37° C.

CFB mRNA levels were quantified by performing RT-qPCR analysis. 2 μl of cDNA were added to a master mix containing 0.5 μl of human or cyno GAPDH TaqMan Probe, 0.5 μl human or cyno CFB probe (Hs00156060_m1) and 5 μl Lightcycler 480 probe master mix (Roche Cat #04887301001) per well in a 384 well plates. Real time PCR was done in a LightCycler480 Real Time PCR system (Roche). To calculate relative fold change, real-time data were analyzed using the Delta-Delta Threshold Cycle (Relative Quantification) ($\Delta\Delta C_q[RQ]$) method [Schmittgen and Livak 2008] and were normalized to control assays performed using cells transfected with PBS. For all samples, CFB mRNA levels were first normalized to GAPDH as a reference gene. Data are expressed as percent of CFB mRNA remaining relative to average PBS control and error is expressed as standard deviation (SD), derived from the 4 transfection replicates.

The results of single dose transfection screens in PHH cells of the dsRNA agents in Tables 2 and 3 are shown in Table 4.

TABLE 4

In Vitro Single dose Screens in Primary Human Hepatocytes

| Duplex Name | 10 nM Average mRNA remaining (%) | 10 nM STDEV | 1 nM Average mRNA remaining (%) | 1 nM STDEV | 0.1 nM Average mRNA remaining (%) | 0.1 nM STDEV |
|---|---|---|---|---|---|---|
| AD-1728447.1 | 14 | 4 | 13 | 4 | 21 | 3 |
| AD-1724362.1 | 17 | 10 | 13 | 3 | 20 | 4 |
| AD-1724363.1 | 19 | 6 | 26 | 7 | 25 | 1 |
| AD-1724364.1 | 16 | 5 | 19 | 1 | 15 | 4 |
| AD-1724365.1 | 38 | 13 | 47 | 8 | 36 | 4 |
| AD-1724369.1 | 23 | 7 | 27 | 7 | 30 | 9 |
| AD-1724370.1 | 25 | 7 | 48 | 5 | 48 | 8 |
| AD-1724376.1 | 20 | 4 | 19 | 3 | 23 | 6 |
| AD-1728461.1 | 22 | 5 | 28 | 3 | 37 | 5 |
| AD-1724384.1 | 69 | 7 | 52 | 9 | 78 | 14 |
| AD-1728470.1 | 42 | 11 | 43 | 10 | 71 | 12 |
| AD-1724385.1 | 47 | 7 | 66 | 6 | 53 | 9 |
| AD-1728471.1 | 30 | 1 | 40 | 7 | 37 | 10 |
| AD-1724386.1 | 37 | 3 | 49 | 6 | 69 | 15 |
| AD-1724530.1 | 14 | 1 | 30 | 6 | 30 | 5 |
| AD-1724572.1 | 31 | 5 | 62 | 8 | 75 | 18 |
| AD-1728659.1 | 26 | 5 | 36 | 6 | 45 | 9 |
| AD-1724574.1 | 13 | 3 | 16 | 0 | 16 | 4 |
| AD-1724575.1 | 17 | 1 | 32 | 5 | 31 | 6 |
| AD-1724576.1 | 11 | 1 | 15 | 1 | 18 | 3 |
| AD-1724579.1 | 21 | 2 | 21 | 2 | 34 | 7 |
| AD-1728664.1 | 76 | 2 | 85 | 10 | 95 | 9 |
| AD-1726815.1 | 55 | 5 | 67 | 6 | 79 | 9 |
| AD-1728671.1 | 55 | 5 | 60 | 9 | 84 | 8 |
| AD-1724586.1 | 27 | 2 | 41 | 8 | 52 | 4 |
| AD-1728685.1 | 60 | 8 | 66 | 8 | 76 | 11 |
| AD-1724600.1 | 21 | 4 | 32 | 5 | 34 | 5 |
| AD-1728736.1 | 12 | 2 | 17 | 4 | 13 | 2 |
| AD-1724651.1 | 8 | 1 | 11 | 1 | 10 | 2 |
| AD-1724653.1 | 13 | 2 | 17 | 3 | 21 | 6 |
| AD-1724685.1 | 15 | 2 | 33 | 2 | 27 | 3 |
| AD-1726927.1 | 12 | 2 | 22 | 3 | 29 | 5 |
| AD-1724691.1 | 13 | 1 | 17 | 2 | 21 | 2 |
| AD-1728777.1 | 25 | 8 | 50 | 7 | 44 | 6 |
| AD-1726928.1 | 20 | 3 | 32 | 2 | 39 | 4 |

TABLE 4-continued

In Vitro Single dose Screens in Primary Human Hepatocytes

| Duplex Name | 10 nM Average mRNA remaining (%) | 10 nM STDEV | 1 nM Average mRNA remaining (%) | 1 nM STDEV | 0.1 nM Average mRNA remaining (%) | 0.1 nM STDEV |
|---|---|---|---|---|---|---|
| AD-1724692.1 | 9 | 1 | 16 | 2 | 14 | 3 |
| AD-1724693.1 | 8 | 1 | 11 | 1 | 14 | 2 |
| AD-1726931.1 | 56 | 5 | 61 | 5 | 75 | 3 |
| AD-1724695.1 | 12 | 2 | 24 | 4 | 21 | 1 |
| AD-1726934.1 | 25 | 3 | 28 | 10 | 49 | 6 |
| AD-1724698.1 | 18 | 2 | 21 | 1 | 25 | 2 |
| AD-1728784.1 | 7 | 1 | 12 | 2 | 10 | 1 |
| AD-1726935.1 | 9 | 2 | 10 | 2 | 13 | 2 |
| AD-1724699.1 | 6 | 1 | 9 | 1 | 6 | 1 |
| AD-1726936.1 | 6 | 2 | 10 | 2 | 12 | 3 |
| AD-1724700.1 | 8 | 1 | 13 | 2 | 10 | 2 |
| AD-1728786.1 | 9 | 1 | 14 | 4 | 12 | 2 |
| AD-1726937.1 | 7 | 1 | 10 | 1 | 9 | 2 |
| AD-1724701.1 | 9 | 2 | 12 | 1 | 8 | 1 |
| AD-1728787.1 | 54 | 8 | 62 | 7 | 69 | 11 |
| AD-1726938.1 | 12 | 3 | 17 | 3 | 18 | 5 |
| AD-1724702.1 | 6 | 1 | 12 | 3 | 9 | 2 |
| AD-1726939.1 | 4 | 1 | 8 | 1 | 9 | 1 |
| AD-1724703.1 | 7 | 1 | 12 | 3 | 12 | 2 |
| AD-1728789.1 | 12 | 2 | 19 | 3 | 22 | 5 |
| AD-1726940.1 | 10 | 1 | 14 | 4 | 15 | 2 |
| AD-1724704.1 | 8 | 1 | 11 | 2 | 10 | 1 |
| AD-1726941.1 | 14 | 1 | 23 | 8 | 27 | 6 |
| AD-1724705.1 | 13 | 2 | 19 | 6 | 20 | 4 |
| AD-1724706.1 | 3 | 1 | 10 | 2 | 9 | 1 |
| AD-1726942.1 | 7 | 1 | 11 | 3 | 10 | 2 |
| AD-1724707.1 | 10 | 1 | 25 | 2 | 20 | 3 |
| AD-1728793.1 | 14 | 2 | 21 | 8 | 22 | 5 |
| AD-1724708.1 | 10 | 1 | 11 | 1 | 12 | 1 |
| AD-1724714.1 | 12 | 2 | 19 | 5 | 25 | 5 |
| AD-1724715.1 | 10 | 2 | 16 | 5 | 14 | 3 |
| AD-1728801.1 | 6 | 1 | 15 | 8 | 38 | 2 |
| AD-1726952.1 | 12 | 4 | 10 | 3 | 34 | 9 |
| AD-1724716.1 | 15 | 2 | 18 | 3 | 26 | 5 |
| AD-1728802.1 | 52 | 9 | 79 | 13 | 86 | 16 |
| AD-1724717.1 | 31 | 7 | 45 | 9 | 74 | 23 |
| AD-1724718.1 | 8 | 1 | 14 | 3 | 16 | 2 |
| AD-1726961.1 | 6 | 0 | 20 | 3 | 20 | 3 |
| AD-1724725.1 | 5 | 3 | 15 | 2 | 17 | 2 |
| AD-1728810.1 | 59 | 15 | 46 | 11 | 46 | 17 |
| AD-1728811.1 | 35 | 12 | 46 | 4 | 58 | 11 |
| AD-1724726.1 | 20 | 8 | 36 | 7 | 40 | 15 |
| AD-1724730.1 | 16 | 4 | 23 | 7 | 27 | 5 |
| AD-1724731.1 | 3 | 9 | 53 | 10 | 77 | 16 |
| AD-1724741.1 | 42 | 8 | 52 | 9 | 64 | 23 |
| AD-1724742.1 | 14 | 4 | 22 | 7 | 22 | 5 |
| AD-1728827.1 | 31 | 10 | 43 | 3 | 51 | 8 |
| AD-1724743.1 | 23 | 10 | 23 | 5 | 60 | 18 |
| AD-1728861.1 | 28 | 10 | 20 | 9 | 28 | 12 |
| AD-1727012.1 | 15 | 5 | 18 | 4 | 22 | 8 |
| AD-1724776.1 | 11 | 4 | 15 | 4 | 18 | 5 |
| AD-1724777.1 | 12 | 6 | 18 | 6 | 25 | 9 |
| AD-1728863.1 | 15 | 5 | 21 | 6 | 33 | 13 |
| AD-1724778.1 | 13 | 3 | 20 | 4 | 24 | 5 |
| AD-1724779.1 | 11 | 4 | 26 | 5 | 37 | 5 |
| AD-1724780.1 | 47 | 6 | 65 | 10 | 88 | 13 |
| AD-1724781.1 | 19 | 4 | 32 | 6 | 42 | 3 |
| AD-1728877.1 | 23 | 4 | 32 | 8 | 37 | 7 |
| AD-1724792.1 | 29 | 9 | 38 | 3 | 47 | 7 |
| AD-1724819.1 | 10 | 1 | 15 | 4 | 21 | 4 |
| AD-1724823.1 | 12 | 1 | 13 | 3 | 23 | 9 |
| AD-1727059.1 | 12 | 2 | 18 | 2 | 15 | 2 |
| AD-1728909.1 | 23 | 5 | 3 | 11 | 46 | 5 |
| AD-1724824.1 | 21 | 4 | 35 | 2 | 30 | 4 |
| AD-1724825.1 | 22 | 4 | 27 | 15 | 44 | 7 |
| AD-1724860.1 | 51 | 11 | 55 | 13 | 73 | 6 |
| AD-1724894.1 | 17 | 3 | 31 | 6 | 41 | 9 |
| AD-1724897.1 | 16 | 1 | 27 | 5 | 26 | 4 |
| AD-1724899.1 | 13 | 4 | 21 | 6 | 19 | 2 |
| AD-1724900.1 | 11 | 2 | 22 | 2 | 26 | 3 |
| AD-1724903.1 | 44 | 5 | 46 | 9 | 69 | 14 |
| AD-1727140.1 | 34 | 21 | 47 | 12 | 75 | 10 |

TABLE 4-continued

In Vitro Single dose Screens in Primary Human Hepatocytes

| Duplex Name | 10 nM Average mRNA remaining (%) | 10 nM STDEV | 1 nM Average mRNA remaining (%) | 1 nM STDEV | 0.1 nM Average mRNA remaining (%) | 0.1 nM STDEV |
|---|---|---|---|---|---|---|
| AD-1724904.1 | 40 | 4 | 54 | 12 | 54 | 11 |
| AD-1728990.1 | 13 | 2 | 22 | 3 | 16 | 2 |
| AD-1724905.1 | 15 | 1 | 22 | 3 | 25 | 4 |
| AD-1727142.1 | 51 | 11 | 77 | 12 | 81 | 8 |
| AD-1724906.1 | 42 | 6 | 54 | 5 | 53 | 2 |
| AD-1728995.1 | 25 | 4 | 37 | 1 | 26 | 7 |
| AD-1724910.1 | 14 | 1 | 20 | 3 | 12 | 1 |
| AD-1724919.1 | 25 | 5 | 46 | 9 | 38 | 4 |
| AD-1727181.1 | 52 | 11 | 71 | 19 | 76 | 4 |
| AD-1724945.1 | 17 | 4 | 23 | 6 | 26 | 6 |
| AD-1724946.1 | 31 | 6 | 32 | 6 | 61 | 4 |
| AD-1727183.1 | 17 | 4 | 14 | 7 | 20 | 2 |
| AD-1724947.1 | 15 | 6 | 8 | 2 | 17 | 4 |
| AD-1727184.1 | 84 | 9 | 87 | 3 | 94 | 11 |
| AD-1724948.1 | 37 | 8 | 43 | 5 | 52 | 5 |
| AD-1724949.1 | 35 | 1 | 52 | 11 | 61 | 8 |
| AD-1725000.1 | 27 | 3 | 47 | 9 | 36 | 5 |
| AD-1725003.1 | 59 | 16 | 65 | 9 | 65 | 5 |
| AD-1729089.1 | 112 | 19 | 122 | 19 | 90 | 20 |
| AD-1725004.1 | 97 | 16 | 106 | 8 | 87 | 13 |
| AD-1725013.1 | 27 | 1 | 43 | 5 | 39 | 5 |
| AD-1725017.1 | 48 | 4 | 75 | 11 | 82 | 9 |
| AD-1729103.1 | 52 | 3 | 74 | 4 | 78 | 9 |
| AD-1725018.1 | 39 | 4 | 43 | 3 | 56 | 7 |
| AD-1725019.1 | 71 | 7 | 102 | 8 | 90 | 7 |
| AD-1729105.1 | 66 | 9 | 84 | 17 | 71 | 13 |
| AD-1725020.1 | 18 | 3 | 31 | 5 | 24 | 2 |
| AD-1729106.1 | 32 | 4 | 48 | 8 | 48 | 6 |
| AD-1725021.1 | 19 | 1 | 30 | 6 | 24 | 3 |
| AD-1725022.1 | 35 | 6 | 43 | 7 | 43 | 10 |
| AD-1725023.1 | 23 | 1 | 39 | 5 | 40 | 2 |
| AD-1729110.1 | 23 | 6 | 36 | 4 | 32 | 4 |
| AD-1725025.1 | 16 | 5 | 29 | 5 | 26 | 6 |
| AD-1729112.1 | 35 | 6 | 49 | 11 | 46 | 8 |
| AD-1727263.1 | 36 | 4 | 52 | 5 | 68 | 13 |
| AD-1725027.1 | 35 | 7 | 47 | 3 | 41 | 11 |
| AD-1725028.1 | 21 | 4 | 44 | 7 | 42 | 3 |
| AD-1725033.1 | 73 | 11 | 89 | 15 | 88 | 10 |
| AD-1727275.1 | 52 | 6 | 52 | 8 | 41 | 2 |
| AD-1725039.1 | 26 | 4 | 28 | 3 | 20 | 2 |
| AD-1727276.1 | 107 | 18 | 99 | 11 | 101 | 10 |
| AD-1725040.1 | 29 | 3 | 41 | 2 | 41 | 13 |
| AD-1725041.1 | 13 | 3 | 24 | 5 | 17 | 3 |
| AD-1727278.1 | 76 | 16 | 83 | 16 | 86 | 10 |
| AD-1725042.1 | 17 | 3 | 24 | 6 | 21 | 3 |
| AD-1725043.1 | 12 | 5 | 21 | 3 | 18 | 3 |
| AD-1725044.1 | 7 | 3 | 14 | 5 | 11 | 1 |
| AD-1729130.1 | 62 | 13 | 81 | 13 | 69 | 7 |
| AD-1725045.1 | 16 | 3 | 25 | 3 | 17 | 4 |
| AD-1725046.1 | 19 | 2 | 21 | 5 | 23 | 6 |
| AD-1729132.1 | 62 | 9 | 50 | 6 | 39 | 6 |
| AD-1725047.1 | 19 | 1 | 25 | 5 | 17 | 3 |
| AD-1725048.1 | 15 | 1 | 19 | 2 | 17 | 4 |
| AD-1729134.1 | 34 | 3 | 55 | 11 | 56 | 8 |
| AD-1727285.1 | 23 | 5 | 35 | 3 | 44 | 11 |
| AD-1725049.1 | 14 | 2 | 21 | 5 | 19 | 5 |
| AD-1727286.1 | 32 | 4 | 49 | 9 | 50 | 6 |
| AD-1725050.1 | 17 | 4 | 31 | 9 | 27 | 7 |
| AD-1729136.1 | 16 | 3 | 22 | 3 | 20 | 9 |
| AD-1725051.1 | 10 | 0 | 23 | 3 | 17 | 1 |
| AD-1729137.1 | 7 | 0 | 11 | 2 | 9 | 1 |
| AD-1727288.1 | 5 | 2 | 13 | 2 | 8 | 2 |
| AD-1725052.1 | 9 | 3 | 12 | 1 | 9 | 4 |
| AD-1727289.1 | 9 | 2 | 17 | 2 | 18 | 9 |
| AD-1725053.1 | 11 | 2 | 20 | 4 | 17 | 3 |
| AD-1729139.1 | 7 | 1 | 12 | 2 | 9 | 1 |
| AD-1727290.1 | 8 | 1 | 15 | 4 | 12 | 5 |
| AD-1725054.1 | 5 | 2 | 5 | 0 | 6 | 1 |
| AD-1727291.1 | 9 | 1 | 8 | 2 | 14 | 3 |
| AD-1725055.1 | 6 | 2 | 6 | 2 | 6 | 0 |
| AD-1729141.1 | 9 | 3 | 10 | 4 | 12 | 1 |
| AD-1727292.1 | 7 | 3 | 6 | 2 | 15 | 1 |

TABLE 4-continued

In Vitro Single dose Screens in Primary Human Hepatocytes

| Duplex Name | 10 nM Average mRNA remaining (%) | 10 nM STDEV | 1 nM Average mRNA remaining (%) | 1 nM STDEV | 0.1 nM Average mRNA remaining (%) | 0.1 nM STDEV |
|---|---|---|---|---|---|---|
| AD-1725056.1 | 15 | 4 | 13 | 2 | 17 | 4 |
| AD-1725057.1 | 8 | 1 | 7 | 2 | 5 | 2 |
| AD-1729142.1 | 16 | 1 | 19 | 5 | 23 | 5 |
| AD-1727293.1 | 9 | 1 | 7 | 1 | 5 | 1 |
| AD-1725058.1 | 12 | 3 | 11 | 4 | 25 | 4 |
| AD-1725059.1 | 8 | 3 | 5 | 1 | 12 | 1 |
| AD-1725060.1 | 22 | 2 | 13 | 5 | 9 | 1 |
| AD-1725061.1 | 18 | 4 | 13 | 3 | 9 | 1 |
| AD-1727298.1 | 29 | 3 | 21 | 3 | 11 | 1 |
| AD-1725062.1 | 27 | 3 | 19 | 2 | 8 | 1 |
| AD-1725066.1 | 28 | 5 | 15 | 2 | 14 | 5 |
| AD-1729151.1 | 40 | 4 | 27 | 3 | 22 | 4 |
| AD-1727310.1 | 85 | 6 | 57 | 13 | 71 | 6 |
| AD-1725074.1 | 25 | 1 | 16 | 2 | 11 | 1 |
| AD-1725075.1 | 22 | 1 | 13 | 3 | 11 | 1 |
| AD-1725079.1 | 38 | 8 | 22 | 4 | 21 | 3 |
| AD-1725080.1 | 65 | 4 | 46 | 5 | 59 | 2 |
| AD-1727318.1 | 38 | 3 | 25 | 3 | 15 | 1 |
| AD-1725082.1 | 26 | 6 | 15 | 4 | 8 | 1 |
| AD-1725083.1 | 30 | 7 | 19 | 5 | 11 | 2 |
| AD-1725088.1 | 69 | 5 | 41 | 10 | 40 | 4 |
| AD-1725092.1 | 47 | 7 | 31 | 8 | 1 | 2 |
| AD-1725095.1 | 7 | 2 | 6 | 2 | 5 | 1 |
| AD-1729180.1 | 52 | 5 | 54 | 7 | 57 | 9 |
| AD-1727331.1 | 28 | 3 | 21 | 6 | 30 | 3 |
| AD-1725096.1 | 18 | 1 | 11 | 3 | 6 | 1 |
| AD-1729207.1 | 76 | 9 | 59 | 8 | 90 | 11 |
| AD-1727358.1 | 42 | 4 | 38 | 7 | 50 | 6 |
| AD-1725122.1 | 31 | 3 | 21 | 4 | 21 | 2 |
| AD-1727359.1 | 62 | 11 | 38 | 4 | 29 | 5 |
| AD-1725123.1 | 33 | 3 | 22 | 2 | 41 | 8 |
| AD-1725125.1 | 21 | 5 | 11 | 3 | 6 | 1 |
| AD-1727361.1 | 26 | 3 | 15 | 5 | 9 | 2 |
| AD-1727392.1 | 24 | 2 | 13 | 2 | 9 | 1 |
| AD-1725156.1 | 19 | 1 | 11 | 5 | 16 | 3 |
| AD-1729242.1 | 22 | 2 | 15 | 6 | 11 | 1 |
| AD-1725158.1 | 50 | 6 | 32 | 6 | 40 | 8 |
| AD-1725159.1 | 63 | 10 | 45 | 8 | 42 | 6 |
| AD-1729269.1 | 52 | 1 | 51 | 5 | 51 | 3 |
| AD-1727420.1 | 24 | 4 | 18 | 1 | 13 | 3 |
| AD-1725184.1 | 22 | 4 | 16 | 2 | 9 | 1 |
| AD-1729271.1 | 47 | 5 | 31 | 5 | 23 | 3 |
| AD-1725186.1 | 39 | 5 | 21 | 1 | 16 | 2 |
| AD-1729274.1 | 43 | 5 | 37 | 2 | 40 | 5 |
| AD-1725189.1 | 29 | 5 | 17 | 2 | 14 | 1 |
| AD-1725190.1 | 22 | 5 | 14 | 5 | 12 | 1 |
| AD-1727427.1 | 74 | 8 | 56 | 5 | 66 | 8 |
| AD-1725191.1 | 27 | 3 | 25 | 4 | 21 | 1 |
| AD-1729277.1 | 51 | 12 | 33 | 5 | 35 | 2 |
| AD-1727428.1 | 97 | 4 | 65 | 9 | 70 | 4 |
| AD-1725192.1 | 20 | 2 | 15 | 2 | 9 | 1 |
| AD-1725193.1 | 18 | 1 | 9 | 1 | 12 | 4 |
| AD-1727430.1 | 26 | 6 | 16 | 4 | 17 | 2 |
| AD-1725194.1 | 13 | 2 | 9 | 1 | 8 | 1 |
| AD-1729280.1 | 27 | 5 | 23 | 2 | 20 | 5 |
| AD-1727431.1 | 30 | 8 | 21 | 4 | 20 | 2 |
| AD-1725195.1 | 25 | 6 | 16 | 3 | 13 | 3 |
| AD-1727432.1 | 19 | 4 | 14 | 4 | 9 | 1 |
| AD-1725196.1 | 18 | 5 | 15 | 1 | 11 | 1 |
| AD-1727433.1 | 68 | 19 | 43 | 7 | 65 | 4 |
| AD-1725197.1 | 33 | 12 | 27 | 5 | 52 | 3 |
| AD-1727434.1 | 50 | 10 | 49 | 3 | 36 | 2 |
| AD-1725198.1 | 24 | 5 | 21 | 2 | 23 | 3 |
| AD-1727435.1 | 46 | 13 | 36 | 4 | 35 | 4 |
| AD-1725199.1 | 30 | 7 | 27 | 3 | 26 | 6 |
| AD-1729285.1 | 37 | 8 | 38 | 7 | 32 | 3 |
| AD-1727436.1 | 36 | 8 | 25 | 3 | 36 | 9 |
| AD-1725200.1 | 17 | 5 | 16 | 2 | 14 | 1 |
| AD-1729288.1 | 98 | 12 | 91 | 17 | 92 | 15 |
| AD-1725203.1 | 64 | 16 | 69 | 8 | 52 | 4 |
| AD-1725204.1 | 77 | 18 | 77 | 17 | 73 | 7 |
| AD-1729290.1 | 26 | 4 | 25 | 2 | 5 | 2 |

TABLE 4-continued

In Vitro Single dose Screens in Primary Human Hepatocytes

| Duplex Name | 10 nM Average mRNA remaining (%) | 10 nM STDEV | 1 nM Average mRNA remaining (%) | 1 nM STDEV | 0.1 nM Average mRNA remaining (%) | 0.1 nM STDEV |
|---|---|---|---|---|---|---|
| AD-1727441.1 | 49 | 10 | 52 | 7 | 55 | 7 |
| AD-1725205.1 | 31 | 7 | 35 | 1 | 27 | 4 |
| AD-1725206.1 | 23 | 4 | 31 | 4 | 39 | 4 |
| AD-1727442.1 | 45 | 11 | 44 | 6 | 48 | 5 |
| AD-1725208.1 | 13 | 4 | 16 | 2 | 15 | 2 |
| AD-1729296.1 | 28 | 8 | 33 | 6 | 16 | 5 |
| AD-1725211.1 | 28 | 9 | 32 | 3 | 39 | 3 |
| AD-1725212.1 | 16 | 9 | 21 | 3 | 20 | 4 |
| AD-1729300.1 | 58 | 16 | 48 | 6 | 77 | 15 |
| AD-1725215.1 | 15 | 3 | 20 | 6 | 33 | 5 |
| AD-1725216.1 | 20 | 6 | 28 | 12 | 33 | 5 |
| AD-1725243.1 | 32 | 4 | 37 | 10 | 49 | 8 |
| AD-1725244.1 | 12 | 3 | 16 | 4 | 10 | 3 |
| AD-1727481.1 | 22 | 2 | 36 | 4 | 23 | 0 |
| AD-1725245.1 | 16 | 1 | 22 | 3 | 15 | 4 |
| AD-1727483.1 | 30 | 2 | 41 | 7 | 48 | 9 |
| AD-1725247.1 | 13 | 2 | 25 | 3 | 24 | 3 |
| AD-1725327.1 | 22 | 4 | 35 | 7 | 27 | 5 |
| AD-1729413.1 | 68 | 19 | 82 | 10 | 87 | 6 |
| AD-1725328.1 | 39 | 3 | 57 | 9 | 75 | 10 |
| AD-1727565.1 | 7 | 6 | 90 | 5 | 94 | 5 |
| AD-1725329.1 | 54 | 8 | 91 | 15 | 103 | 16 |
| AD-1727566.1 | 70 | 10 | 90 | 9 | 105 | 13 |
| AD-1725330.1 | 62 | 10 | 76 | 6 | 92 | 10 |
| AD-1725331.1 | 31 | 4 | 67 | 4 | 73 | 17 |
| AD-1727568.1 | 85 | 10 | 105 | 11 | 88 | 8 |
| AD-1725332.1 | 54 | 5 | 59 | 8 | 63 | 7 |
| AD-1727569.1 | 21 | 3 | 37 | 7 | 41 | 7 |
| AD-1725333.1 | 24 | 4 | 38 | 4 | 44 | 6 |
| AD-1727570.1 | 22 | 4 | 34 | 5 | 38 | 5 |
| AD-1725334.1 | 20 | 4 | 32 | 4 | 26 | 8 |
| AD-1725336.1 | 17 | 5 | 34 | 10 | 30 | 6 |
| AD-1725344.1 | 39 | 6 | 54 | 10 | 64 | 17 |
| AD-1725345.1 | 38 | 2 | 62 | 5 | 68 | 5 |
| AD-1725347.1 | 35 | 3 | 50 | 11 | 49 | 4 |
| AD-1727584.1 | 32 | 5 | 44 | 2 | 36 | 7 |
| AD-1725348.1 | 15 | 3 | 24 | 1 | 22 | 4 |
| AD-1727612.1 | 35 | 8 | 20 | 1 | 40 | 5 |
| AD-1725376.1 | 16 | 6 | 45 | 13 | 41 | 7 |
| AD-1729461.1 | 66 | 13 | 78 | 16 | 79 | 3 |
| AD-1729462.1 | 34 | 19 | 93 | 6 | 99 | 8 |
| AD-1725377.1 | 62 | 15 | 87 | 16 | 89 | 9 |
| AD-1729463.1 | 28 | 6 | 58 | 2 | 46 | 5 |
| AD-1725378.1 | 25 | 4 | 44 | 4 | 43 | 5 |
| AD-1727633.1 | 47 | 7 | 64 | 14 | 58 | 11 |
| AD-1725397.1 | 16 | 3 | 24 | 6 | 20 | 5 |
| AD-1729487.1 | 13 | 0 | 21 | 1 | 10 | 3 |
| AD-1727638.1 | 11 | 1 | 23 | 2 | 15 | 3 |
| AD-1725402.1 | 14 | 2 | 25 | 3 | 15 | 3 |
| AD-1727639.1 | 14 | 2 | 23 | 6 | 14 | 3 |
| AD-1725403.1 | 12 | 3 | 21 | 4 | 13 | 2 |
| AD-1727640.1 | 37 | 5 | 60 | 6 | 68 | 11 |
| AD-1725404.1 | 16 | 2 | 35 | 3 | 27 | 7 |
| AD-1727641.1 | 13 | 2 | 26 | 5 | 20 | 1 |
| AD-1725405.1 | 9 | 1 | 15 | 2 | 11 | 2 |
| AD-1727642.1 | 47 | 8 | 82 | 13 | 78 | 8 |
| AD-1725406.1 | 17 | 1 | 26 | 4 | 23 | 4 |
| AD-1727643.1 | 21 | 1 | 36 | 9 | 31 | 5 |
| AD-1725407.1 | 13 | 1 | 26 | 3 | 20 | 5 |
| AD-1727644.1 | 14 | 1 | 24 | 2 | 23 | 4 |
| AD-1725408.1 | 8 | 1 | 15 | 1 | 10 | 1 |
| AD-1727645.1 | 14 | 2 | 21 | 2 | 15 | 2 |
| AD-1725409.1 | 12 | 3 | 16 | 3 | 12 | 2 |
| AD-1727646.1 | 47 | 6 | 74 | 10 | 83 | 11 |
| AD-1725410.1 | 22 | 1 | 37 | 4 | 32 | 4 |
| AD-1725411.1 | 24 | 3 | 44 | 6 | 44 | 7 |
| AD-1730469.1 | 72 | 3 | 96 | 1 | 102 | 4 |
| AD-1730470.1 | 36 | 4 | 55 | 11 | 76 | 4 |
| AD-1730471.1 | 16 | 3 | 27 | 5 | 30 | 6 |
| AD-1727663.1 | 45 | 4 | 60 | 15 | 54 | 5 |
| AD-1725427.1 | 18 | 2 | 34 | 2 | 27 | 2 |
| AD-1727664.1 | 32 | 5 | 53 | 3 | 45 | 6 |

TABLE 4-continued

In Vitro Single dose Screens in Primary Human Hepatocytes

| Duplex Name | 10 nM Average mRNA remaining (%) | 10 nM STDEV | 1 nM Average mRNA remaining (%) | 1 nM STDEV | 0.1 nM Average mRNA remaining (%) | 0.1 nM STDEV |
|---|---|---|---|---|---|---|
| AD-1725428.1 | 21 | 3 | 35 | 5 | 29 | 3 |
| AD-1729514.1 | 13 | 2 | 21 | 3 | 15 | 3 |
| AD-1727665.1 | 12 | 3 | 19 | 4 | 20 | 3 |
| AD-1725429.1 | 11 | 2 | 22 | 5 | 14 | 2 |
| AD-1729515.1 | 37 | 5 | 36 | 5 | 34 | 3 |
| AD-1727666.1 | 15 | 2 | 23 | 4 | 14 | 3 |
| AD-1725430.1 | 11 | 1 | 13 | 5 | 13 | 3 |
| AD-1729524.1 | 30 | 3 | 56 | 5 | 49 | 4 |
| AD-1727675.1 | 24 | 5 | 35 | 9 | 26 | 5 |
| AD-1725439.1 | 29 | 6 | 44 | 10 | 45 | 10 |
| AD-1725440.1 | 25 | 1 | 32 | 4 | 29 | 3 |
| AD-1729525.1 | 29 | 8 | 47 | 8 | 59 | 11 |
| AD-1727677.1 | 30 | 6 | 47 | 6 | 41 | 2 |
| AD-1725441.1 | 21 | 2 | 28 | 1 | 26 | 2 |
| AD-1725449.1 | 32 | 7 | 41 | 7 | 29 | 8 |
| AD-1729538.1 | 29 | 3 | 55 | 4 | 51 | 8 |
| AD-1727689.1 | 41 | 5 | 67 | 8 | 61 | 9 |
| AD-1725453.1 | 29 | 9 | 47 | 5 | 54 | 8 |
| AD-1727690.1 | 9 | 4 | 14 | 5 | 16 | 4 |
| AD-1725454.1 | 15 | 3 | 18 | 4 | 24 | 2 |
| AD-1729541.1 | 9 | 4 | 26 | 2 | 17 | 4 |
| AD-1725456.1 | 13 | 3 | 18 | 1 | 15 | 2 |
| AD-1727693.1 | 11 | 1 | 18 | 3 | 11 | 2 |
| AD-1725457.1 | 9 | 2 | 20 | 2 | 11 | 3 |
| AD-1729545.1 | 15 | 3 | 22 | 4 | 18 | 2 |
| AD-1727696.1 | 12 | 3 | 9 | 3 | 15 | 3 |
| AD-1725460.1 | 5 | 2 | 8 | 2 | 11 | 2 |
| AD-1727698.1 | 19 | 1 | 20 | 2 | 23 | 10 |
| AD-1725462.1 | 5 | 1 | 9 | 3 | 8 | 3 |
| AD-1729548.1 | 7 | 2 | 9 | 2 | 7 | 3 |
| AD-1727699.1 | 7 | 2 | 7 | 2 | 10 | 2 |
| AD-1725463.1 | 4 | 1 | 7 | 3 | 7 | 1 |
| AD-1725464.1 | 3 | 1 | 8 | 1 | 10 | 1 |
| AD-1729550.1 | 26 | 1 | 24 | 11 | 38 | 4 |
| AD-1727701.1 | 13 | 2 | 28 | 2 | 33 | 5 |
| AD-1725465.1 | 9 | 1 | 19 | 4 | 19 | 3 |
| AD-1729552.1 | 25 | 3 | 33 | 3 | 26 | 4 |
| AD-1727703.1 | 6 | 1 | 11 | 2 | 10 | 1 |
| AD-1725467.1 | 7 | 1 | 12 | 2 | 14 | 3 |
| AD-1725469.1 | 7 | 2 | 11 | 1 | 16 | 2 |
| AD-1727705.1 | 16 | 2 | 29 | 2 | 29 | 8 |
| AD-1729555.1 | 7 | 1 | 10 | 1 | 13 | 1 |
| AD-1725470.1 | 11 | 1 | 17 | 2 | 19 | 5 |
| AD-1729557.1 | 42 | 6 | 60 | 3 | 48 | 4 |
| AD-1727708.1 | 12 | 3 | 16 | 2 | 19 | 3 |
| AD-1725472.1 | 9 | 0 | 13 | 2 | 11 | 2 |
| AD-1725473.1 | 11 | 2 | 18 | 3 | 18 | 1 |
| AD-1729559.1 | 18 | 4 | 28 | 6 | 45 | 4 |
| AD-1727710.1 | 39 | 6 | 68 | 11 | 70 | 7 |
| AD-1725474.1 | 19 | 4 | 40 | 2 | 38 | 3 |
| AD-1729561.1 | 11 | 1 | 17 | 1 | 22 | 3 |
| AD-1727712.1 | 10 | 1 | 16 | 1 | 19 | 1 |
| AD-1725476.1 | 6 | 1 | 9 | 1 | 13 | 1 |
| AD-1729562.1 | 4 | 3 | 4 | 1 | 6 | 2 |
| AD-1727713.1 | 8 | 1 | 10 | 1 | 12 | 1 |
| AD-1725477.1 | 7 | 0 | 10 | 0 | 13 | 1 |
| AD-1727714.1 | 9 | 2 | 15 | 1 | 20 | 3 |
| AD-1725478.1 | 9 | 1 | 12 | 1 | 12 | 1 |
| AD-1727717.1 | 23 | 2 | 38 | 4 | 53 | 6 |
| AD-1725481.1 | 17 | 2 | 29 | 6 | 37 | 1 |
| AD-1727718.1 | 19 | 2 | 33 | 3 | 40 | 3 |
| AD-1725482.1 | 16 | 3 | 31 | 4 | 31 | 9 |
| AD-1729567.1 | 65 | 3 | 60 | 8 | 70 | 6 |
| AD-1729568.1 | 20 | 4 | 23 | 3 | 25 | 4 |
| AD-1725483.1 | 13 | 1 | 12 | 2 | 16 | 1 |
| AD-1725534.1 | 13 | 2 | 23 | 8 | 38 | 8 |
| AD-1725535.1 | 6 | 1 | 6 | 1 | 9 | 0 |
| AD-1725548.1 | 5 | 2 | 12 | 3 | 19 | 3 |
| AD-1725552.1 | 29 | 6 | 67 | 7 | 75 | 9 |
| AD-1725556.1 | 13 | 6 | 22 | 6 | 29 | 5 |
| AD-1729643.1 | 9 | 6 | 24 | 6 | 26 | 5 |
| AD-1725558.1 | 20 | 3 | 32 | 8 | 40 | 6 |

TABLE 4-continued

In Vitro Single dose Screens in Primary Human Hepatocytes

| Duplex Name | 10 nM Average mRNA remaining (%) | 10 nM STDEV | 1 nM Average mRNA remaining (%) | 1 nM STDEV | 0.1 nM Average mRNA remaining (%) | 0.1 nM STDEV |
|---|---|---|---|---|---|---|
| AD-1725580.1 | 25 | 5 | 32 | 5 | 35 | 4 |
| AD-1729667.1 | 43 | 7 | 59 | 4 | 68 | 10 |
| AD-1725582.1 | 46 | 8 | 47 | 7 | 55 | 9 |
| AD-1729670.1 | 12 | 3 | 25 | 4 | 34 | 3 |
| AD-1727821.1 | 19 | 2 | 38 | 9 | 46 | 6 |
| AD-1725585.1 | 15 | 1 | 27 | 4 | 41 | 6 |
| AD-1727823.1 | 72 | 8 | 71 | 11 | 77 | 10 |
| AD-1725587.1 | 21 | 2 | 43 | 1 | 48 | 11 |
| AD-1729673.1 | 22 | 2 | 32 | 8 | 33 | 7 |
| AD-1725588.1 | 19 | 4 | 20 | 4 | 31 | 5 |
| AD-1725590.1 | 17 | 4 | 36 | 4 | 55 | 8 |
| AD-1727826.1 | 99 | 18 | 83 | 7 | 84 | 15 |
| AD-1725591.1 | 42 | 5 | 77 | 4 | 78 | 14 |
| AD-1729677.1 | 17 | 2 | 24 | 1 | 29 | 6 |
| AD-1725592.1 | 20 | 2 | 34 | 2 | 47 | 4 |
| AD-1727829.1 | 88 | 22 | 89 | 14 | 93 | 7 |
| AD-1725593.1 | 14 | 2 | 17 | 3 | 33 | 7 |
| AD-1725598.1 | 94 | 24 | 66 | 11 | 79 | 18 |
| AD-1729688.1 | 24 | 3 | 54 | 12 | 61 | 13 |
| AD-1725603.1 | 11 | 3 | 20 | 3 | 23 | 2 |
| AD-1725604.1 | 15 | 4 | 17 | 3 | 29 | 4 |
| AD-1729690.1 | 88 | 9 | 83 | 12 | 86 | 17 |
| AD-1725605.1 | 64 | 11 | 49 | 8 | 67 | 12 |
| AD-1725643.1 | 7 | 0 | 10 | 2 | 15 | 1 |
| AD-1725644.1 | 2 | 0 | 11 | 3 | 13 | 3 |
| AD-1729729.1 | 28 | 6 | 31 | 7 | 41 | 11 |
| AD-1725645.1 | 18 | 7 | 42 | 7 | 41 | 5 |
| AD-1725646.1 | 13 | 5 | 37 | 7 | 46 | 9 |
| AD-1727883.1 | 16 | 6 | 28 | 6 | 44 | 9 |
| AD-1725647.1 | 14 | 3 | 17 | 5 | 29 | 8 |
| AD-1725667.1 | 23 | 4 | 30 | 6 | 40 | 6 |
| AD-1725716.1 | 67 | 14 | 49 | 12 | 62 | 15 |
| AD-1725717.1 | 22 | 2 | 46 | 9 | 63 | 14 |
| AD-1729802.1 | 102 | 26 | 77 | 11 | 79 | 13 |
| AD-1729841.1 | 3 | 1 | 7 | 2 | 11 | 2 |
| AD-1727977.1 | 2 | 0 | 6 | 1 | 12 | 5 |
| AD-1725756.1 | 3 | 0 | 6 | 2 | 10 | 2 |
| AD-1727978.1 | 11 | 2 | 11 | 2 | 15 | 4 |
| AD-1725757.1 | 6 | 1 | 7 | 2 | 10 | 2 |
| AD-1727980.1 | 7 | 2 | 8 | 2 | 11 | 4 |
| AD-1725759.1 | 7 | 2 | 6 | 1 | 13 | 2 |
| AD-1727981.1 | 6 | 0 | 7 | 1 | 10 | 1 |
| AD-1725760.1 | 7 | 1 | 8 | 2 | 11 | 1 |
| AD-1725761.1 | 6 | 2 | 7 | 2 | 9 | 2 |
| AD-1725762.1 | 9 | 3 | 17 | 2 | 19 | 3 |
| AD-1727984.1 | 7 | 1 | 9 | 1 | 10 | 2 |
| AD-1725763.1 | 3 | 1 | 5 | 1 | 8 | 2 |
| AD-1727985.1 | 7 | 1 | 10 | 2 | 17 | 4 |
| AD-1725764.1 | 4 | 1 | 5 | 2 | 11 | 1 |
| AD-1729849.1 | 42 | 10 | 31 | 5 | 41 | 11 |
| AD-1729850.1 | 12 | 4 | 14 | 3 | 21 | 2 |
| AD-1727986.1 | 5 | 1 | 9 | 2 | 13 | 1 |
| AD-1725765.1 | 8 | 1 | 14 | 2 | 22 | 2 |
| AD-1727987.1 | 6 | 1 | 8 | 1 | 12 | 2 |
| AD-1725766.1 | 5 | 1 | 9 | 2 | 12 | 2 |
| AD-1725767.1 | 6 | 1 | 10 | 2 | 14 | 1 |
| AD-1729852.1 | 33 | 7 | 43 | 7 | 58 | 16 |
| AD-1727989.1 | 10 | 2 | 13 | 3 | 16 | 2 |
| AD-1725768.1 | 9 | 2 | 15 | 3 | 18 | 2 |
| AD-1729854.1 | 21 | 1 | 31 | 5 | 32 | 3 |
| AD-1727990.1 | 10 | 1 | 17 | 2 | 19 | 3 |
| AD-1725769.1 | 8 | 1 | 14 | 1 | 20 | 2 |
| AD-1727992.1 | 9 | 1 | 15 | 4 | 21 | 2 |
| AD-1725771.1 | 8 | 2 | 12 | 3 | 7 | 4 |
| AD-1729856.1 | 14 | 4 | 24 | 3 | 29 | 2 |
| AD-1727993.1 | 13 | 1 | 24 | 3 | 18 | 6 |
| AD-1725772.1 | 7 | 1 | 9 | 1 | 10 | 2 |
| AD-1727994.1 | 23 | 2 | 40 | 6 | 43 | 7 |
| AD-1725773.1 | 7 | 2 | 11 | 3 | 15 | 1 |
| AD-1727996.1 | 19 | 8 | 30 | 2 | 53 | 7 |
| AD-1725775.1 | 45 | 10 | 55 | 8 | 71 | 8 |
| AD-1729861.1 | 60 | 5 | 69 | 2 | 79 | 6 |

TABLE 4-continued

In Vitro Single dose Screens in Primary Human Hepatocytes

| Duplex Name | 10 nM Average mRNA remaining (%) | 10 nM STDEV | 1 nM Average mRNA remaining (%) | 1 nM STDEV | 0.1 nM Average mRNA remaining (%) | 0.1 nM STDEV |
|---|---|---|---|---|---|---|
| AD-1725776.1 | 23 | 6 | 29 | 9 | 57 | 9 |
| AD-1729862.1 | 37 | 10 | 42 | 6 | 42 | 2 |
| AD-1725777.1 | 8 | 2 | 12 | 3 | 15 | 2 |
| AD-1727999.1 | 50 | 7 | 64 | 14 | 78 | 9 |
| AD-1725778.1 | 17 | 5 | 25 | 3 | 35 | 3 |
| AD-1725779.1 | 16 | 1 | 21 | 1 | 29 | 4 |
| AD-1725780.1 | 7 | 1 | 11 | 1 | 11 | 2 |
| AD-1729869.1 | 28 | 1 | 43 | 5 | 57 | 11 |
| AD-1725784.1 | 10 | 2 | 15 | 1 | 17 | 1 |
| AD-1729870.1 | 30 | 2 | 50 | 13 | 59 | 4 |
| AD-1725785.1 | 13 | 1 | 21 | 3 | 34 | 2 |
| AD-1725786.1 | 16 | 4 | 22 | 3 | 30 | 2 |
| AD-1729872.1 | 44 | 3 | 51 | 12 | 54 | 5 |
| AD-1725787.1 | 16 | 3 | 24 | 3 | 28 | 5 |
| AD-1725789.1 | 11 | 1 | 16 | 2 | 20 | 3 |
| AD-1725790.1 | 20 | 1 | 29 | 4 | 37 | 6 |
| AD-1728049.1 | 102 | 14 | 94 | 11 | 100 | 14 |
| AD-1725828.1 | 26 | 5 | 34 | 6 | 46 | 9 |
| AD-1725829.1 | 44 | 7 | 50 | 8 | 64 | 3 |
| AD-1725830.1 | 11 | 2 | 21 | 5 | 26 | 5 |
| AD-1725831.1 | 18 | 5 | 21 | 3 | 24 | 2 |
| AD-1725832.1 | 15 | 1 | 26 | 4 | 37 | 4 |
| AD-1728061.1 | 38 | 5 | 40 | 5 | 50 | 10 |
| AD-1725840.1 | 43 | 3 | 32 | 4 | 29 | 2 |
| AD-1729926.1 | 44 | 6 | 50 | 4 | 45 | 5 |
| AD-1728062.1 | 38 | 4 | 37 | 4 | 46 | 6 |
| AD-1725841.1 | 13 | 2 | 15 | 2 | 20 | 3 |
| AD-1725842.1 | 12 | 2 | 17 | 2 | 22 | 6 |
| AD-1725845.1 | 56 | 12 | 74 | 7 | 81 | 18 |
| AD-1728067.1 | 85 | 10 | 98 | 21 | 108 | 12 |
| AD-1725846.1 | 42 | 6 | 68 | 7 | 75 | 11 |
| AD-1729933.1 | 16 | 1 | 22 | 5 | 21 | 1 |
| AD-1725848.1 | 12 | 2 | 14 | 1 | 15 | 3 |
| AD-1725849.1 | 14 | 4 | 17 | 5 | 28 | 5 |
| AD-1725850.1 | 31 | 4 | 39 | 9 | 58 | 6 |
| AD-1725854.1 | 12 | 1 | 15 | 7 | 23 | 7 |
| AD-1725855.1 | 8 | 1 | 10 | 5 | 19 | 2 |
| AD-1729941.1 | 30 | 3 | 47 | 7 | 59 | 5 |
| AD-1725856.1 | 20 | 4 | 32 | 1 | 39 | 6 |
| AD-1725857.1 | 10 | 0 | 15 | 2 | 18 | 4 |
| AD-1725858.1 | 25 | 4 | 36 | 8 | 46 | 7 |
| AD-1725861.1 | 39 | 6 | 41 | 7 | 66 | 12 |
| AD-1729947.1 | 51 | 7 | 46 | 14 | 53 | 2 |
| AD-1725862.1 | 40 | 4 | 51 | 6 | 66 | 7 |
| AD-1728085.1 | 25 | 5 | 50 | 10 | 48 | 8 |
| AD-1725864.1 | 11 | 2 | 20 | 3 | 25 | 4 |
| AD-1729951.1 | 27 | 7 | 45 | 7 | 59 | 11 |
| AD-1725866.1 | 16 | 4 | 29 | 7 | 40 | 9 |
| AD-1725867.1 | 24 | 6 | 34 | 6 | 54 | 5 |
| AD-1725872.1 | 15 | 2 | 17 | 3 | 26 | 6 |
| AD-1725874.1 | 20 | 8 | 25 | 3 | 39 | 8 |
| AD-1729992.1 | 60 | 8 | 34 | 8 | 41 | 13 |
| AD-1725907.1 | 45 | 10 | 29 | 10 | 54 | 10 |
| AD-1729993.1 | 51 | 9 | 25 | 4 | 47 | 13 |
| AD-1725908.1 | 15 | 0 | 13 | 4 | 19 | 2 |
| AD-1729994.1 | 47 | 12 | 60 | 10 | 79 | 18 |
| AD-1725909.1 | 17 | 3 | 29 | 10 | 42 | 7 |
| AD-1728132.1 | 31 | 7 | 35 | 7 | 65 | 4 |
| AD-1725911.1 | 36 | 5 | 36 | 7 | 58 | 10 |
| AD-1730001.1 | 6 | 1 | 10 | 4 | 21 | 4 |
| AD-1728137.1 | 6 | 1 | 10 | 2 | 19 | 3 |
| AD-1725916.1 | 5 | 1 | 10 | 2 | 12 | 1 |
| AD-1728140.1 | 7 | 1 | 16 | 6 | 28 | 4 |
| AD-1725919.1 | 7 | 3 | 16 | 5 | 22 | 5 |
| AD-1728146.1 | 10 | 1 | 16 | 2 | 26 | 8 |
| AD-1725925.1 | 6 | 1 | 10 | 2 | 24 | 7 |
| AD-1730042.1 | 18 | 2 | 37 | 4 | 65 | 14 |
| AD-1725957.1 | 24 | 3 | 32 | 3 | 50 | 9 |
| AD-1725958.1 | 18 | 1 | 28 | 6 | 42 | 8 |
| AD-1725961.1 | 8 | 1 | 16 | 4 | 21 | 3 |
| AD-1730048.1 | 10 | 1 | 17 | 2 | 27 | 5 |
| AD-1725963.1 | 15 | 3 | 19 | 4 | 26 | 4 |

TABLE 4-continued

In Vitro Single dose Screens in Primary Human Hepatocytes

| Duplex Name | 10 nM Average mRNA remaining (%) | 10 nM STDEV | 1 nM Average mRNA remaining (%) | 1 nM STDEV | 0.1 nM Average mRNA remaining (%) | 0.1 nM STDEV |
|---|---|---|---|---|---|---|
| AD-1725964.1 | 18 | 4 | 15 | 3 | 22 | 6 |
| AD-1725967.1 | 15 | 3 | 26 | 8 | 33 | 4 |
| AD-1730053.1 | 62 | 7 | 51 | 11 | 73 | 17 |
| AD-1725968.1 | 46 | 7 | 39 | 7 | 56 | 7 |
| AD-1730059.1 | 31 | 6 | 51 | 6 | 85 | 23 |
| AD-1728195.1 | 23 | 4 | 38 | 4 | 67 | 13 |
| AD-1725974.1 | 11 | 3 | 16 | 1 | 46 | 13 |
| AD-1725977.1 | 20 | 4 | 24 | 2 | 25 | 15 |
| AD-1730068.1 | 11 | 1 | 13 | 2 | 11 | 5 |
| AD-1728204.1 | 15 | 1 | 18 | 3 | 38 | 5 |
| AD-1725983.1 | 11 | 2 | 15 | 3 | 24 | 4 |
| AD-1728206.1 | 11 | 1 | 16 | 3 | 40 | 10 |
| AD-1725985.1 | 7 | 2 | 12 | 2 | 21 | 2 |
| AD-1728207.1 | 12 | 3 | 23 | 2 | 25 | 7 |
| AD-1725986.1 | 18 | 4 | 22 | 3 | 25 | 4 |
| AD-1728208.1 | 13 | 1 | 22 | 1 | 35 | 2 |
| AD-1725987.1 | 13 | 3 | 17 | 2 | 24 | 2 |
| AD-1728209.1 | 46 | 6 | 70 | 6 | 101 | 10 |
| AD-1725988.1 | 20 | 7 | 28 | 5 | 43 | 7 |
| AD-1725989.1 | 23 | 4 | 38 | 1 | 66 | 7 |
| AD-1728210.1 | 26 | 4 | 42 | 1 | 65 | 8 |
| AD-1728212.1 | 16 | 2 | 23 | 3 | 57 | 7 |
| AD-1725991.1 | 10 | 1 | 18 | 4 | 31 | 6 |
| AD-1730077.1 | 46 | 2 | 62 | 6 | 102 | 8 |
| AD-1725992.1 | 33 | 2 | 54 | 8 | 92 | 10 |
| AD-1728214.1 | 17 | 2 | 30 | 5 | 74 | 16 |
| AD-1725993.1 | 13 | 2 | 25 | 7 | 50 | 5 |
| AD-1728220.1 | 10 | 2 | 10 | 4 | 34 | 2 |
| AD-1725999.1 | 11 | 2 | 16 | 3 | 32 | 3 |
| AD-1726014.1 | 41 | 5 | 68 | 13 | 100 | 31 |
| AD-1726015.1 | 30 | 5 | 53 | 11 | 98 | 16 |
| AD-1726016.1 | 49 | 9 | 76 | 14 | 114 | 5 |
| AD-1730103.1 | 38 | 8 | 56 | 7 | 92 | 12 |
| AD-1726018.1 | 29 | 10 | 42 | 4 | 80 | 10 |
| AD-1726020.1 | 34 | 5 | 45 | 3 | 74 | 24 |
| AD-1730108.1 | 63 | 5 | 79 | 13 | 109 | 14 |
| AD-1728244.1 | 58 | 9 | 85 | 9 | 109 | 12 |
| AD-1726023.1 | 40 | 6 | 44 | 7 | 105 | 14 |
| AD-1726024.1 | 31 | 9 | 51 | 9 | 88 | 18 |
| AD-1730110.1 | 44 | 6 | 53 | 4 | 108 | 17 |
| AD-1726025.1 | 21 | 3 | 34 | 9 | 65 | 10 |
| AD-1730112.1 | 62 | 12 | 76 | 9 | 92 | 10 |
| AD-1726027.1 | 23 | 5 | 36 | 4 | 66 | 14 |
| AD-1726029.1 | 17 | 5 | 41 | 7 | 76 | 7 |
| AD-1726031.1 | 20 | 3 | 31 | 5 | 53 | 10 |
| AD-1730118.1 | 48 | 8 | 74 | 13 | 96 | 13 |
| AD-1726033.1 | 34 | 4 | 64 | 5 | 99 | 11 |
| AD-1726034.1 | 18 | 5 | 33 | 5 | 53 | 11 |
| AD-1726036.1 | 7 | 1 | 15 | 4 | 22 | 2 |
| AD-1728258.1 | 3 | 0 | 15 | 4 | 43 | 3 |
| AD-1726037.1 | 9 | 2 | 15 | 4 | 32 | 7 |
| AD-1730122.1 | 12 | 3 | 18 | 3 | 37 | 6 |
| AD-1728260.1 | 21 | 2 | 34 | 4 | 70 | 7 |
| AD-1726039.1 | 15 | 1 | 22 | 3 | 55 | 12 |
| AD-1726041.1 | 19 | 2 | 35 | 5 | 75 | 13 |
| AD-1726042.1 | 36 | 8 | 52 | 11 | 96 | 13 |
| AD-1730472.1 | 14 | 5 | 24 | 7 | 66 | 11 |
| AD-1730133.1 | 8 | 2 | 21 | 2 | 32 | 4 |
| AD-1728269.1 | 12 | 2 | 25 | 2 | 55 | 10 |
| AD-1726048.1 | 7 | 2 | 13 | 1 | 24 | 1 |
| AD-1728270.1 | 14 | 5 | 35 | 8 | 90 | 20 |
| AD-1726049.1 | 18 | 6 | 42 | 7 | 81 | 6 |
| AD-1728271.1 | 11 | 4 | 20 | 2 | 38 | 10 |
| AD-1726050.1 | 8 | 2 | 13 | 3 | 19 | 4 |
| AD-1726051.1 | 4 | 1 | 6 | 2 | 10 | 3 |
| AD-1728272.1 | 20 | 4 | 30 | 3 | 64 | 16 |
| AD-1728273.1 | 4 | 2 | 9 | 4 | 20 | 3 |
| AD-1726052.1 | 4 | 1 | 9 | 2 | 19 | 5 |
| AD-1728274.1 | 7 | 2 | 13 | 1 | 28 | 7 |
| AD-1726053.1 | 5 | 1 | 9 | 3 | 17 | 4 |
| AD-1728275.1 | 8 | 4 | 15 | 4 | 35 | 9 |
| AD-1726054.1 | 6 | 3 | 12 | 3 | 22 | 6 |

TABLE 4-continued

In Vitro Single dose Screens in Primary Human Hepatocytes

| Duplex Name | 10 nM Average mRNA remaining (%) | 10 nM STDEV | 1 nM Average mRNA remaining (%) | 1 nM STDEV | 0.1 nM Average mRNA remaining (%) | 0.1 nM STDEV |
|---|---|---|---|---|---|---|
| AD-1728276.1 | 4 | 1 | 8 | 4 | 15 | 5 |
| AD-1726055.1 | 6 | 2 | 11 | 2 | 15 | 1 |
| AD-1728277.1 | 7 | 1 | 9 | 2 | 17 | 3 |
| AD-1726056.1 | 6 | 1 | 7 | 1 | 13 | 2 |
| AD-1728278.1 | 5 | 1 | 10 | 3 | 12 | 3 |
| AD-1726057.1 | 6 | 1 | 7 | 1 | 14 | 2 |
| AD-1726058.1 | 7 | 1 | 12 | 3 | 11 | 5 |
| AD-1730143.1 | 8 | 2 | 14 | 1 | 19 | 3 |
| AD-1728279.1 | 7 | 1 | 13 | 2 | 21 | 2 |
| AD-1726059.1 | 8 | 1 | 16 | 2 | 18 | 3 |
| AD-1726060.1 | 9 | 1 | 16 | 4 | 18 | 2 |
| AD-1728282.1 | 17 | 2 | 29 | 9 | 62 | 11 |
| AD-1726061.1 | 9 | 2 | 17 | 2 | 33 | 7 |
| AD-1728283.1 | 15 | 2 | 30 | 5 | 39 | 3 |
| AD-1726062.1 | 7 | 0 | 14 | 3 | 15 | 2 |
| AD-1728284.1 | 12 | 1 | 20 | 2 | 28 | 5 |
| AD-1726063.1 | 11 | 0 | 15 | 3 | 29 | 6 |
| AD-1728285.1 | 8 | 1 | 16 | 3 | 31 | 3 |
| AD-1726064.1 | 11 | 1 | 17 | 5 | 27 | 5 |
| AD-1728286.1 | 14 | 4 | 25 | 4 | 64 | 10 |
| AD-1726065.1 | 9 | 1 | 14 | 1 | 27 | 6 |
| AD-1730474.1 | 18 | 3 | 28 | 11 | 56 | 6 |
| AD-1730473.1 | 15 | 2 | 28 | 5 | 56 | 8 |
| AD-1730475.1 | 9 | 1 | 13 | 2 | 20 | 3 |
| AD-1730164.1 | 29 | 4 | 42 | 4 | 47 | 7 |
| AD-1728300.1 | 18 | 2 | 27 | 2 | 38 | 1 |
| AD-1726079.1 | 14 | 2 | 23 | 7 | 35 | 4 |
| AD-1728301.1 | 12 | 2 | 16 | 2 | 24 | 3 |
| AD-1726080.1 | 9 | 2 | 14 | 2 | 20 | 4 |
| AD-1728302.1 | 6 | 2 | 7 | 3 | 9 | 2 |
| AD-1726081.1 | 7 | 3 | 9 | 3 | 16 | 3 |
| AD-1730167.1 | 8 | 2 | 9 | 5 | 16 | 6 |
| AD-1728303.1 | 9 | 1 | 16 | 1 | 17 | 3 |
| AD-1726082.1 | 10 | 0 | 17 | 2 | 20 | 6 |
| AD-1730168.1 | 27 | 6 | 51 | 7 | 73 | 7 |
| AD-1726083.1 | 21 | 3 | 37 | 8 | 63 | 13 |
| AD-1726084.1 | 11 | 1 | 18 | 1 | 24 | 5 |
| AD-1730169.1 | 20 | 2 | 23 | 3 | 32 | 5 |
| AD-1726085.1 | 9 | 3 | 21 | 2 | 33 | 5 |
| AD-1730171.1 | 21 | 3 | 39 | 3 | 49 | 7 |
| AD-1728307.1 | 17 | 1 | 32 | 5 | 50 | 6 |
| AD-1726086.1 | 15 | 5 | 29 | 4 | 53 | 11 |
| AD-1728308.1 | 16 | 3 | 25 | 3 | 44 | 6 |
| AD-1726087.1 | 11 | 2 | 15 | 2 | 21 | 2 |
| AD-1728311.1 | 50 | 13 | 73 | 14 | 109 | 15 |
| AD-1726090.1 | 21 | 2 | 42 | 9 | 70 | 10 |
| AD-1728312.1 | 55 | 4 | 60 | 12 | 104 | 19 |
| AD-1726091.1 | 18 | 3 | 32 | 5 | 46 | 8 |
| AD-1726092.1 | 32 | 5 | 71 | 9 | 82 | 7 |
| AD-1726095.1 | 68 | 8 | 73 | 9 | 79 | 12 |
| AD-1728317.1 | 34 | 2 | 40 | 5 | 42 | 9 |
| AD-1726096.1 | 16 | 2 | 24 | 4 | 24 | 5 |
| AD-1728318.1 | 106 | 19 | 45 | 15 | 110 | 4 |
| AD-1726097.1 | 17 | 4 | 28 | 6 | 38 | 4 |
| AD-1730183.1 | 61 | 7 | 71 | 14 | 94 | 16 |
| AD-1726098.1 | 54 | 3 | 69 | 10 | 90 | 9 |
| AD-1730184.1 | 69 | 6 | 74 | 4 | 93 | 12 |
| AD-1728320.1 | 48 | 9 | 73 | 12 | 94 | 4 |
| AD-1726099.1 | 40 | 7 | 71 | 11 | 79 | 7 |
| AD-1726103.1 | 70 | 12 | 83 | 11 | 73 | 5 |
| AD-1728324.1 | 67 | 9 | 71 | 12 | 68 | 13 |
| AD-1726113.1 | 51 | 7 | 74 | 3 | 88 | 8 |
| AD-1726159.1 | 15 | 4 | 32 | 5 | 39 | 8 |
| AD-1730256.1 | 35 | 6 | 42 | 7 | 56 | 6 |
| AD-1726171.1 | 15 | 2 | 21 | 2 | 32 | 4 |
| AD-1728405.1 | 30 | 7 | 42 | 5 | 67 | 9 |
| AD-1726184.1 | 11 | 3 | 19 | 2 | 30 | 8 |
| AD-1728408.1 | 17 | 1 | 39 | 8 | 63 | 9 |
| AD-1726187.1 | 11 | 2 | 22 | 5 | 39 | 11 |
| AD-1728410.1 | 9 | 2 | 17 | 3 | 20 | 4 |
| AD-1726189.1 | 7 | 2 | 14 | 1 | 17 | 4 |
| AD-1728412.1 | 9 | 2 | 19 | 3 | 29 | 6 |

TABLE 4-continued

In Vitro Single dose Screens in Primary Human Hepatocytes

| Duplex Name | 10 nM Average mRNA remaining (%) | 10 nM STDEV | 1 nM Average mRNA remaining (%) | 1 nM STDEV | 0.1 nM Average mRNA remaining (%) | 0.1 nM STDEV |
|---|---|---|---|---|---|---|
| AD-1726191.1 | 9 | 1 | 18 | 3 | 26 | 10 |
| AD-1726201.1 | 8 | 1 | 17 | 1 | 16 | 3 |
| AD-1728422.1 | 12 | 3 | 20 | 6 | 23 | 5 |
| AD-1730287.1 | 13 | 3 | 24 | 2 | 31 | 5 |
| AD-1728423.1 | 15 | 3 | 30 | 5 | 37 | 4 |
| AD-1726202.1 | 15 | 2 | 29 | 7 | 44 | 8 |
| AD-1730288.1 | 12 | 1 | 25 | 6 | 41 | 7 |
| AD-1726203.1 | 11 | 2 | 17 | 4 | 25 | 6 |
| AD-1728427.1 | 16 | 4 | 36 | 4 | 56 | 14 |
| AD-1726206.1 | 12 | 2 | 22 | 3 | 28 | 7 |
| AD-1726207.1 | 4 | 1 | 10 | 1 | 11 | 5 |
| AD-1730293.1 | 13 | 4 | 19 | 3 | 23 | 3 |
| AD-1726208.1 | 6 | 2 | 16 | 2 | 20 | 5 |
| AD-1726209.1 | 7 | 1 | 17 | 4 | 17 | 4 |
| AD-1730476.1 | 22 | 5 | 25 | 3 | 17 | 6 |
| AD-1730477.1 | 7 | 1 | 13 | 3 | 13 | 3 |
| AD-1730478.1 | 21 | 3 | 36 | 7 | 50 | 11 |

Example 3. In Vitro Screening Methods

A subset of the duplexes was also assessed by transfection and free uptake in primary human hepatocytes and primary cynomolgus hepatocytes.

Transfection and free uptake assays were carried out in primary human hepatocyte (PHH, BioIVT) and primary cynomolgus hepatocyte (PCH, BioIVT). Transfection was performed by adding of 5 μl Opti-MEM plus 0.1 μl of Lipofectamine RNAiMax per well (Invitrogen, Carlsbad CA cat #13778-150) to 5 μl of siRNA duplexes per well into a 384-well plate and incubated at room temperature for 15 minutes. 40 μl of Invitrogro CP media (BioIVT, Cat #Z99029) containing ~10×10³ cells were then added to the siRNA mixture. Cells were incubated for 24 hours prior to RNA purification. Experiments were performed at 10 nM, 1 nM, 0.1 nM and 0.01 nM. Free uptake assay was performed similarly to transfection assay without using Lipofectamine RNAimax and cells were incubated for 48 hours prior to the RNA purification. Experiments were performed at 200 nM, 100 nM, 10 nM, 1 nM.

RNA was isolated using an Highres Biosolution integration system using Dynabeads™ mRNA DIRECT™ Purification Kit (Invitrogen™, Catalog No. 61012). Briefly, 70 μL of Lysis/Binding Buffer and 10 μL of lysis buffer containing 3 μL of magnetic beads were added to the plate with cells. Plates were incubated on an electromagnetic shaker for 10 minutes at room temperature and then magnetic beads were captured and the supernatant was removed. Bead-bound RNA was then washed 2 times with 90 μL Wash Buffer A and once with 90 μL Wash Buffer B. Beads were then washed with 90 μL Elution Buffer, re-captured, and supernatant was removed. Complementary DNA (cDNA) was synthesized using High-Capacity cDNA Reverse Transcription Kit with RNase Inhibitor (Applied Biosystems™, Catalog No. 4374967) according to the manufacturer's recommendations. A master mix containing 1 μL 10× Buffer, 0.4 μL 25× deoxyribonucleotide triphosphate, 1 μL 10× Random primers, 0.5 μL Reverse Transcriptase, 0.5 μL RNase inhibitor, and 6.6 μL of $H_2O$ per reaction was added to RNA isolated above. The plates were sealed, mixed, and incubated on an electromagnetic shaker for 10 minutes at room temperature, followed by 2 hours incubation at 37° C.

CFB mRNA levels were quantified by performing RT-qPCR analysis. 2 μl of cDNA were added to a master mix containing 0.5 μl of human or cyno GAPDH TaqMan Probe, 0.5 μl human or cyno CFB probe (Hs00156060_m1) and 5 μl Lightcycler 480 probe master mix (Roche Cat #04887301001) per well in a 384 well plates. Real time PCR was done in a LightCycler480 Real Time PCR system (Roche). To calculate relative fold change, real-time data were analyzed using the Delta-Delta Threshold Cycle (Relative Quantification) ($\Delta\Delta C_q$[RQ]) method [Schmittgen and Livak 2008] and were normalized to control assays performed using cells transfected with PBS. For all samples, CFB mRNA levels were first normalized to GAPDH as a reference gene. Data are expressed as percent of CFB mRNA remaining relative to average PBS control and error is expressed as standard deviation (SD), derived from the 4 transfection replicates.

The results of single dose transfection screens and free uptake screens in PHH and PCH cells are shown in Tables 5 and 6, respectively.

TABLE 5

In Vitro Single Dose Transfection and Free Update Screens in Primary Human Hepatocytes

| | Primary Human Hepatocytes Transfection | | | | | | | | | | Primary Human Hepatocytes Free Uptake | | | | | | | |
|---|---|---|---|---|---|---|---|---|---|---|---|---|---|---|---|---|---|---|
| Duplex Name | 10 nM Avg | 10 nM Stdev | 1 nM Avg | 1 nM Stdev | 0.1 nM Avg | 0.1 nM Stdev | 0.01 nM Avg | 0.01 nM Stdev | | | 200 nM Avg | 200 nM Stdev | 100 nM Avg | 100 nM Stdev | 10 nM Avg | 10 nM Stdev | 1 nM Avg | 1 nM StdeV |
| AD-1724704.1 | 8 | 2 | 7 | 3 | 15 | 3 | 19 | 2 | | | 9 | 3 | 8 | 2 | 33 | 5 | 50 | 8 |
| AD-1729137.1 | 8 | 2 | 12 | 3 | 20 | 5 | 25 | 3 | | | 32 | 2 | 30 | 3 | 53 | 1 | 87 | 11 |
| AD-1725059.1 | 6 | 2 | 8 | 1 | 13 | 4 | 18 | 4 | | | 10 | 1 | 10 | 1 | 27 | 4 | 61 | 17 |
| AD-1727392.1 | 9 | 2 | 12 | 4 | 20 | 4 | 27 | 5 | | | 27 | 4 | 62 | 18 | 54 | 4 | 32 | 3 |
| AD-1725408.1 | 7 | 2 | 11 | 2 | 16 | 4 | 18 | 3 | | | 16 | 2 | 15 | 2 | 46 | 5 | 68 | 5 |
| AD-1727703.1 | 9 | 1 | 15 | 1 | 21 | 4 | 23 | 2 | | | 31 | 3 | 33 | 6 | 63 | 4 | 74 | 7 |
| AD-1724478.1 | 10 | 0 | 13 | 1 | 20 | 4 | 27 | 4 | | | 20 | 2 | 91 | 6 | 51 | 7 | 38 | 5 |
| AD-1725759.1 | 13 | 2 | 19 | 3 | 25 | 3 | 33 | 5 | | | 30 | 5 | 29 | 6 | 69 | 7 | 86 | 7 |
| AD-1725771.1 | 8 | 1 | 15 | 4 | 19 | 2 | 31 | 4 | | | 20 | 2 | 24 | 6 | 56 | 5 | 88 | 3 |
| AD-1726051.1 | 16 | 2 | 16 | 3 | 21 | 4 | 18 | 4 | | | 17 | 5 | 24 | 4 | 59 | 7 | 79 | 6 |
| AD-1726057.1 | 14 | 5 | 13 | 3 | 12 | 1 | 8 | 5 | | | 14 | 3 | 14 | 3 | 42 | 8 | 50 | 9 |
| AD-1724693.1 | 8 | 2 | 8 | 2 | 22 | 0 | 29 | 3 | | | 22 | 1 | 22 | 2 | 43 | 2 | 39 | 2 |
| AD-1724706.1 | 7 | 1 | 15 | 3 | 18 | 2 | 33 | 5 | | | 12 | 2 | 15 | 1 | 35 | 2 | 63 | 16 |
| AD-1727288.1 | 8 | 4 | 1 | 2 | 24 | 5 | 24 | 5 | | | 16 | 4 | 20 | 2 | 46 | 2 | 69 | 9 |
| AD-1725060.1 | 12 | 1 | 18 | 5 | 38 | 4 | 50 | 5 | | | 44 | 3 | 42 | 2 | 73 | 6 | 96 | 7 |
| AD-1725192.1 | 15 | 2 | 20 | 2 | 16 | 10 | 44 | 6 | | | 38 | 2 | 41 | 5 | 50 | 10 | 78 | 16 |
| AD-1725430.1 | 7 | 1 | 8 | 1 | 16 | 4 | 18 | 2 | | | 19 | 3 | 17 | 5 | 46 | 7 | 65 | 10 |
| AD-1725469.1 | 15 | 3 | 17 | 4 | 32 | 6 | 41 | 9 | | | 43 | 8 | 41 | 4 | 77 | 9 | 96 | 16 |
| AD-1725535.1 | 8 | 1 | 13 | 3 | 22 | 2 | 21 | 7 | | | 18 | 3 | 21 | 2 | 51 | 5 | 75 | 13 |
| AD-1727981.1 | 13 | 1 | 16 | 4 | 21 | 3 | 28 | 2 | | | 27 | 2 | 32 | 5 | 61 | 4 | 89 | 13 |
| AD-1725772.1 | 10 | 1 | 16 | 3 | 22 | 6 | 31 | 4 | | | 20 | 4 | 25 | 2 | 54 | 19 | 107 | 15 |
| AD-1728273.1 | 16 | 3 | 19 | 2 | 33 | 3 | 29 | 8 | | | 19 | 5 | 23 | 1 | 58 | 6 | 81 | 31 |
| AD-1726058.1 | 7 | 2 | 15 | 2 | 15 | 3 | 18 | 5 | | | 13 | 5 | 16 | 2 | 50 | 7 | 61 | 13 |
| AD-1728784.1 | 7 | 2 | 7 | 2 | 19 | 2 | 21 | 6 | | | 16 | 2 | 16 | 7 | 39 | 8 | 38 | 21 |
| AD-1724708.1 | 9 | 2 | 12 | 2 | 24 | 5 | 26 | 3 | | | 12 | 4 | 15 | 1 | 43 | 9 | 69 | 23 |
| AD-1725193.1 | 12 | 4 | 18 | 1 | 24 | 6 | 28 | 6 | | | 21 | 2 | 19 | 4 | 46 | 6 | 75 | 6 |
| AD-1726460.1 | 14 | 4 | 19 | 4 | 31 | 5 | 40 | 4 | | | 70 | 9 | 61 | 3 | 94 | 6 | 95 | 10 |
| AD-1729555.1 | 10 | 2 | 14 | 3 | 33 | 7 | 31 | 8 | | | 27 | 8 | 26 | 1 | 68 | 7 | 99 | 11 |
| AD-1725643.1 | 10 | 1 | 19 | 5 | 32 | 9 | 23 | 7 | | | 26 | 3 | 26 | 3 | 59 | 2 | 83 | 28 |
| AD-1726052.1 | 14 | 2 | 17 | 5 | 26 | 6 | 28 | 5 | | | 15 | 2 | 20 | 1 | 51 | 3 | 85 | 5 |
| AD-1726062.1 | 4 | 1 | 17 | 2 | 23 | 11 | 26 | 8 | | | 15 | 1 | 18 | 3 | 45 | 9 | 48 | 3 |
| AD-1726936.1 | 5 | 2 | 7 | 3 | 19 | 4 | 28 | 2 | | | 15 | 5 | 13 | 7 | 30 | 13 | 35 | 15 |
| AD-1724715.1 | 11 | 3 | 18 | 5 | 26 | 6 | 46 | 11 | | | 22 | 4 | 25 | 3 | 45 | 11 | 66 | 21 |
| AD-1725055.1 | 5 | 2 | 8 | 2 | 20 | 2 | 21 | 5 | | | 17 | 2 | 20 | 1 | 47 | 2 | 74 | 11 |
| AD-1725061.1 | 14 | 2 | 18 | 4 | 35 | 7 | 34 | 4 | | | 33 | 1 | 30 | 2 | 73 | 6 | 85 | 6 |
| AD-1725194.1 | 13 | 3 | 14 | 2 | 26 | 6 | 23 | 5 | | | 16 | 2 | 16 | 2 | 40 | 6 | 62 | 9 |
| AD-1725462.1 | 13 | 2 | 14 | 3 | 34 | 7 | 36 | 6 | | | 46 | 4 | 29 | 3 | 69 | 13 | 80 | 11 |
| AD-1725472.1 | 10 | 3 | 17 | 1 | 28 | 9 | 27 | 3 | | | 32 | 5 | 102 | 7 | 60 | 5 | 103 | 20 |
| AD-1725644.1 | 13 | 2 | 21 | 6 | 31 | 6 | 31 | 2 | | | 38 | 4 | 35 | 8 | 68 | 13 | 89 | 16 |
| AD-1725761.1 | 10 | 1 | 17 | 3 | 31 | 5 | 27 | 5 | | | 29 | 3 | 37 | 3 | 81 | 10 | 112 | 18 |
| AD-1725773.1 | 12 | 1 | 19 | 3 | 27 | 4 | 38 | 7 | | | 31 | 7 | 34 | 5 | 75 | 11 | 110 | 8 |
| AD-1726053.1 | 14 | 2 | 19 | 2 | 22 | 2 | 23 | 4 | | | 14 | 4 | 17 | 0 | 45 | 4 | 62 | 25 |
| AD-1728302.1 | 10 | 2 | 14 | 3 | 25 | 8 | 25 | 8 | | | 12 | 3 | 19 | 4 | 47 | 9 | 73 | 12 |
| AD-1728786.1 | 7 | 2 | 9 | 1 | 16 | 3 | 19 | 4 | | | 16 | 1 | 19 | 4 | 38 | 17 | 47 | 4 |

TABLE 5-continued

In Vitro Single Dose Tranfection and Free Update Screens in Primary Human Hepatocytes

| | Primary Human Hepatocytes Transfection | | | | | | | | | | Primary Human Hepatocytes Free Uptake | | | | | | | |
|---|---|---|---|---|---|---|---|---|---|---|---|---|---|---|---|---|---|
| Duplex Name | 10 nM Avg | 10 nM Stdev | 1 nM Avg | 1 nM Stdev | 0.1 nM Avg | 0.1 nM Stdev | 0.01 nM Avg | 0.01 nM Stdev | 200 nM Avg | 200 nM Stdev | 100 nM Avg | 100 nM Stdev | 10 nM Avg | 10 nM Stdev | 1 nM Avg | 1 nM StdeV |
| AD-1724718.1 | 11 | 1 | 19 | 4 | 27 | 4 | 30 | 5 | 14 | 3 | 22 | 2 | 52 | 2 | 71 | 5 |
| AD-1729141.1 | 15 | 4 | 17 | 2 | 30 | 5 | 28 | 5 | 31 | 7 | 34 | 4 | 57 | 5 | 107 | 19 |
| AD-1725075.1 | 20 | 5 | 19 | 3 | 25 | 4 | 34 | 3 | 25 | 4 | 26 | 5 | 60 | 10 | 86 | 14 |
| AD-1727432.1 | 14 | 2 | 17 | 2 | 23 | 3 | 31 | 5 | 24 | 5 | 104 | 10 | 56 | 6 | 82 | 12 |
| AD-1729548.1 | 14 | 2 | 20 | 4 | 31 | 2 | 36 | 8 | 43 | 7 | 42 | 5 | 80 | 9 | 100 | 9 |
| AD-1725476.1 | 11 | 2 | 19 | 2 | 32 | 8 | 28 | 8 | 24 | 4 | 35 | 1 | 83 | 7 | 111 | 8 |
| AD-1729841.1 | 13 | 1 | 21 | 4 | 29 | 6 | 25 | 6 | 36 | 8 | 41 | 3 | 74 | 2 | 111 | 16 |
| AD-1725763.1 | 8 | 4 | 16 | 4 | 31 | 8 | 37 | 5 | 20 | 4 | 25 | 2 | 60 | 2 | 97 | 10 |
| AD-1725777.1 | 14 | 1 | 18 | 4 | 18 | 1 | 21 | 6 | 24 | 7 | 27 | 5 | 65 | 8 | 90 | 22 |
| AD-1728276.1 | 15 | 2 | 23 | 2 | 34 | 16 | 29 | 8 | 18 | 5 | 22 | 3 | 44 | 11 | 94 | 25 |
| AD-1730167.1 | 10 | 1 | 14 | 2 | 16 | 8 | 20 | 5 | 7 | 4 | 15 | 4 | 35 | 8 | 50 | 15 |
| AD-1726937.1 | 6 | 1 | 9 | 1 | 8 | 2 | 20 | 3 | 11 | 2 | 11 | 1 | 33 | 2 | 44 | 9 |
| AD-1724725.1 | 9 | 1 | 14 | 2 | 22 | 1 | 25 | 4 | 15 | 3 | 19 | 1 | 41 | 5 | 59 | 12 |
| AD-1727292.1 | 11 | 1 | 14 | 2 | 24 | 4 | 31 | 6 | 21 | 3 | 25 | 1 | 49 | 7 | 79 | 13 |
| AD-1725095.1 | 12 | 2 | 13 | 1 | 21 | 4 | 27 | 5 | 15 | 2 | 15 | 1 | 39 | 4 | 66 | 6 |
| AD-1725244.1 | 18 | 2 | 21 | 3 | 35 | 9 | 37 | 9 | 42 | 4 | 39 | 5 | 80 | 14 | 97 | 11 |
| AD-1725463.1 | 8 | 2 | 13 | 3 | 22 | 8 | 26 | 9 | 21 | 3 | 23 | 3 | 57 | 9 | 80 | 10 |
| AD-1729562.1 | 11 | 2 | 14 | 2 | 26 | 5 | 19 | 4 | 18 | 3 | 16 | 3 | 43 | 3 | 71 | 7 |
| AD-1725756.1 | 10 | 2 | 12 | 2 | 23 | 5 | 24 | 2 | 24 | 2 | 26 | 3 | 58 | 5 | 87 | 10 |
| AD-1725764.1 | 7 | 1 | 13 | 2 | 29 | 7 | 25 | 4 | 24 | 5 | 117 | 4 | 59 | 4 | 95 | 18 |
| AD-1730001.1 | 16 | 2 | 25 | 11 | 22 | 5 | 32 | 7 | 29 | 5 | 107 | 15 | 75 | 9 | 105 | 13 |
| AD-1726056.1 | 14 | 2 | 20 | 2 | 30 | 9 | 25 | 3 | 12 | 2 | 15 | 2 | 43 | 7 | 79 | 17 |
| AD-1726189.1 | 11 | 3 | 18 | 2 | 18 | 1 | 23 | 8 | 15 | 5 | 23 | 5 | 43 | 9 | 88 | 11 |
| AD-1724702.1 | 6 | 2 | 11 | 2 | 15 | 4 | 23 | 7 | 15 | 0 | 15 | 1 | 36 | 9 | 50 | 8 |
| AD-1724910.1 | 9 | 2 | 13 | 3 | 22 | 3 | 23 | 2 | 21 | 3 | 16 | 2 | 38 | 1 | 60 | 7 |
| AD-1727293.1 | 6 | 1 | 10 | 3 | 14 | 1 | 19 | 4 | 20 | 5 | 23 | 3 | 48 | 4 | 77 | 8 |
| AD-1725096.1 | 11 | 3 | 16 | 2 | 30 | 6 | 34 | 5 | 22 | 3 | 25 | 2 | 55 | 6 | 81 | 14 |
| AD-1729487.1 | 13 | 3 | 20 | 2 | 40 | 9 | 31 | 5 | 31 | 7 | 33 | 12 | 70 | 11 | 96 | 21 |
| AD-1725464.1 | 9 | 3 | 14 | 4 | 26 | 7 | 27 | 7 | 21 | 3 | 28 | 1 | 64 | 8 | 91 | 12 |
| AD-1727713.1 | 11 | 1 | 16 | 3 | 32 | 4 | 34 | 5 | 26 | 5 | 22 | 2 | 67 | 6 | 97 | 7 |
| AD-1725757.1 | 10 | 2 | 14 | 2 | 26 | 3 | 28 | 8 | 21 | 1 | 22 | 3 | 51 | 1 | 93 | 5 |
| AD-1727986.1 | 7 | 2 | 12 | 3 | 29 | 8 | 27 | 7 | 17 | 6 | 24 | 2 | 60 | 10 | 80 | 13 |
| AD-1725916.1 | 8 | 1 | 12 | 2 | 22 | 7 | 24 | 3 | 16 | 4 | 21 | 3 | 55 | 7 | 85 | 22 |
| AD-1728278.1 | 13 | 2 | 20 | 4 | 28 | 12 | 25 | 6 | 17 | 2 | 23 | 4 | 49 | 4 | 81 | 17 |
| AD-1726207.1 | 9 | 4 | 19 | 5 | 28 | 6 | 28 | 3 | 19 | 5 | 27 | 6 | 49 | 9 | 59 | 7 |
| AD-1726939.1 | 5 | 1 | 7 | 1 | 12 | 4 | 18 | 5 | 11 | 1 | 11 | 2 | 28 | 4 | 33 | 5 |
| AD-1725044.1 | 4 | 1 | 8 | 2 | 16 | 4 | 22 | 7 | 19 | 3 | 20 | 2 | 43 | 9 | 46 | 10 |
| AD-1725057.1 | 6 | 3 | 11 | 2 | 20 | 4 | 23 | 3 | 16 | 2 | 20 | 2 | 47 | 9 | 64 | 14 |
| AD-1725125.1 | 13 | 2 | 20 | 2 | 37 | 11 | 40 | 6 | 49 | 4 | 63 | 12 | 85 | 13 | 90 | 12 |
| AD-1725405.1 | 6 | 2 | 9 | 2 | 20 | 6 | 25 | 8 | 17 | 3 | 21 | 1 | 57 | 12 | 66 | 9 |
| AD-1725477.1 | 9 | 2 | 13 | 2 | 28 | 4 | 27 | 5 | 18 | 3 | 25 | 2 | 56 | 7 | 73 | 6 |
| AD-1727980.1 | 11 | 2 | 15 | 2 | 24 | 3 | 25 | 4 | 18 | 3 | 11 | 3 | 55 | 7 | 79 | 17 |
| AD-1725767.1 | 9 | 2 | 17 | 4 | 41 | 11 | 37 | 9 | 24 | 6 | 35 | 4 | 66 | 1 | 87 | 9 |
| AD-1730068.1 | 18 | 8 | 18 | 5 | 11 | 6 | 26 | 5 | 30 | 10 | 43 | 2 | 77 | 5 | 92 | 29 |
| AD-1730477.1 | 9 | 1 | 14 | 5 | 27 | 7 | 26 | 7 | 21 | 3 | 24 | 2 | 52 | 3 | 108 | 34 |

TABLE 6

In Vitro Single Dose Tranfection and Free Update Screens in Primary Cynomolgus Hepatocytes

| | Primary Cyno Hepatocytes Transfection | | | | | | | | | Primary Cyno Hepatocytes Free Uptake | | | | | | |
|---|---|---|---|---|---|---|---|---|---|---|---|---|---|---|---|---|
| Duplex Name | 10 nM Avg | 10 nM Stdev | 1 nM Avg | 1 nM Stdev | 0.1 nM Avg | 0.1 nM Stdev | 0.01 nM Avg | 0.01 nM Stdev | 200 nM Avg | 200 nM Stdev | 100 nM Avg | 100 nM Stdev | 10 nM Avg | 10 nM Stdev | 1 nM Avg | 1 nM StdeV |
| AD-1724704.1 | 2 | 1 | 6 | 1 | 11 | 2 | 12 | 3 | 16 | 1 | 20 | 2 | 41 | 2 | 62 | 5 |
| AD-1729137.1 | 5 | 0 | 11 | 1 | 19 | 1 | 21 | 1 | 58 | 1 | 59 | 6 | 72 | 2 | 91 | 6 |
| AD-1725059.1 | 2 | 0 | 4 | 0 | 9 | 1 | 12 | 1 | 18 | 1 | 21 | 3 | 41 | 3 | 62 | 4 |
| AD-1727392.1 | 12 | 1 | 25 | 2 | 42 | 1 | 53 | 3 | 56 | 2 | 56 | 4 | 80 | 4 | 93 | 4 |
| AD-1725408.1 | 2 | 0 | 7 | 1 | 11 | 1 | 15 | 1 | 26 | 2 | 28 | 4 | 47 | 3 | 68 | 4 |
| AD-1727703.1 | 5 | 1 | 11 | 0 | 18 | 1 | 24 | 2 | 50 | 7 | 49 | 4 | 76 | 2 | 89 | 3 |
| AD-1725478.1 | 3 | 0 | 7 | 1 | 12 | 1 | 17 | 1 | 28 | 2 | 33 | 4 | 56 | 2 | 72 | 1 |
| AD-1725759.1 | 9 | 5 | 12 | 1 | 19 | 1 | 24 | 1 | 43 | 2 | 44 | 1 | 66 | 4 | 83 | 5 |
| AD-1725771.1 | 4 | 1 | 10 | 2 | 17 | 1 | 23 | 1 | 31 | 2 | 33 | 1 | 56 | 1 | 75 | 4 |
| AD-1726051.1 | 6 | 1 | 11 | 1 | 16 | 1 | 23 | 2 | 41 | 3 | 44 | 3 | 70 | 4 | 87 | 2 |
| AD-1726057.1 | 4 | 1 | 12 | 2 | 15 | 1 | 21 | 1 | 33 | 1 | 43 | 2 | 72 | 4 | 91 | 2 |
| AD-1724693.1 | 5 | 1 | 11 | 1 | 22 | 2 | 30 | 3 | 36 | 3 | 37 | 2 | 59 | 3 | 79 | 4 |
| AD-1724706.1 | 2 | 0 | 6 | 1 | 11 | 1 | 16 | 2 | 15 | 0 | 20 | 1 | 38 | 1 | 57 | 2 |
| AD-1727288.1 | 3 | 1 | 7 | 1 | 13 | 1 | 17 | 1 | 34 | 2 | 35 | 3 | 48 | 9 | 70 | 4 |
| AD-1725060.1 | 6 | 1 | 16 | 1 | 29 | 3 | 37 | 2 | 46 | 1 | 48 | 3 | 69 | 4 | 81 | 1 |
| AD-1725192.1 | 4 | 0 | 11 | 1 | 19 | 2 | 24 | 2 | 48 | 3 | 49 | 4 | 70 | 8 | 79 | 3 |
| AD-1725430.1 | 3 | 1 | 5 | 1 | 8 | 1 | 12 | 1 | 21 | 0 | 21 | 1 | 39 | 2 | 60 | 3 |
| AD-1725469.1 | 5 | 1 | 13 | 2 | 21 | 1 | 28 | 3 | 45 | 2 | 45 | 2 | 67 | 4 | 83 | 6 |
| AD-1725535.1 | 2 | 0 | 6 | 1 | 9 | 2 | 12 | 1 | 21 | 2 | 23 | 0 | 45 | 2 | 67 | 4 |
| AD-1727981.1 | 4 | 1 | 8 | 1 | 15 | 2 | 19 | 1 | 33 | 1 | 36 | 3 | 57 | 7 | 73 | 7 |
| AD-1725772.1 | 4 | 1 | 9 | 2 | 14 | 2 | 22 | 3 | 34 | 4 | 32 | 2 | 52 | 2 | 74 | 4 |
| AD-1728273.1 | 6 | 0 | 11 | 1 | 17 | 1 | 22 | 2 | 42 | 10 | 39 | 3 | 63 | 4 | 81 | 6 |
| AD-1726058.1 | 4 | 0 | 7 | 1 | 11 | 1 | 16 | 2 | 29 | 3 | 32 | 2 | 54 | 2 | 73 | 2 |
| AD-1728784.1 | 4 | 0 | 8 | 1 | 19 | 2 | 24 | 5 | 31 | 11 | 38 | 2 | 61 | 2 | 79 | 4 |
| AD-1724708.1 | 3 | 0 | 6 | 1 | 13 | 1 | 17 | 1 | 20 | 1 | 21 | 0 | 44 | 1 | 62 | 2 |
| AD-1725193.1 | 3 | 0 | 6 | 0 | 12 | 2 | 19 | 2 | 31 | 1 | 32 | 2 | 53 | 6 | 72 | 3 |
| AD-1725460.1 | 5 | 0 | 12 | 0 | 22 | 3 | 29 | 2 | 68 | 2 | 63 | 4 | 74 | 5 | 83 | 3 |
| AD-1729555.1 | 3 | 0 | 9 | 1 | 15 | 1 | 20 | 2 | 32 | 2 | 33 | 1 | 56 | 4 | 74 | 1 |
| AD-1725643.1 | 5 | 1 | 11 | 1 | 17 | 2 | 21 | 1 | 24 | 1 | 26 | 0 | 48 | 2 | 71 | 5 |
| AD-1726052.1 | 5 | 0 | 10 | 1 | 16 | 2 | 19 | 1 | 32 | 2 | 37 | 2 | 60 | 4 | 78 | 3 |
| AD-1726062.1 | 4 | 0 | 9 | 1 | 15 | 1 | 20 | 1 | 33 | 1 | 37 | 1 | 60 | 2 | 81 | 3 |
| AD-1726936.1 | 3 | 0 | 10 | 1 | 16 | 1 | 22 | 2 | 34 | 3 | 30 | 3 | 52 | 3 | 73 | 3 |
| AD-1724715.1 | 3 | 0 | 10 | 1 | 19 | 2 | 26 | 1 | 26 | 2 | 27 | 2 | 50 | 2 | 68 | 1 |
| AD-1725055.1 | 3 | 1 | 6 | 1 | 11 | 1 | 15 | 1 | 29 | 1 | 30 | 0 | 50 | 3 | 66 | 4 |
| AD-1725061.1 | 4 | 0 | 9 | 1 | 17 | 1 | 25 | 2 | 31 | 2 | 32 | 2 | 51 | 2 | 69 | 5 |
| AD-1725194.1 | 2 | 0 | 5 | 0 | 8 | 1 | 13 | 2 | 21 | 1 | 22 | 2 | 41 | 3 | 59 | 2 |
| AD-1725462.1 | 4 | 1 | 10 | 1 | 18 | 2 | 24 | 1 | 36 | 2 | 36 | 2 | 55 | 3 | 74 | 4 |
| AD-1725472.1 | 3 | 1 | 8 | 1 | 14 | 1 | 18 | 2 | 33 | 3 | 33 | 1 | 49 | 3 | 66 | 2 |
| AD-1725644.1 | 6 | 1 | 13 | 1 | 21 | 2 | 24 | 1 | 40 | 2 | 40 | 2 | 60 | 3 | 78 | 4 |
| AD-1725761.1 | 4 | 1 | 8 | 1 | 15 | 3 | 19 | 1 | 33 | 2 | 33 | 2 | 55 | 2 | 70 | 2 |
| AD-1725773.1 | 6 | 2 | 12 | 1 | 22 | 2 | 25 | 3 | 36 | 3 | 37 | 3 | 58 | 2 | 77 | 4 |
| AD-1726053.1 | 4 | 1 | 7 | 1 | 12 | 1 | 13 | 1 | 25 | 2 | 29 | 3 | 48 | 4 | 68 | 3 |
| AD-1728302.1 | 4 | 1 | 9 | 1 | 15 | 0 | 18 | 2 | 29 | 2 | 34 | 2 | 59 | 3 | 78 | 3 |
| AD-1728786.1 | 4 | 1 | 11 | 2 | 16 | 0 | 21 | 1 | 38 | 1 | 38 | 2 | 61 | 4 | 81 | 3 |

TABLE 6-continued

In Vitro Single Dose Tranfection and Free Update Screens in Primary Cynomolgus Hepatocytes

| | Primary Cyno Hepatocytes Transfection | | | | | | Primary Cyno Hepatocytes Free Uptake | | | | | | | |
|---|---|---|---|---|---|---|---|---|---|---|---|---|---|---|
| Duplex Name | 10 nM Avg | 10 nM Stdev | 1 nM Avg | 1 nM Stdev | 0.1 nM Avg | 0.1 nM Stdev | 0.01 nM Avg | 0.01 nM Stdev | 200 nM Avg | 200 nM Stdev | 100 nM Avg | 100 nM Stdev | 10 nM Avg | 10 nM Stdev | 1 nM Avg | 1 nM StdeV |
| AD-1724718.1 | 3 | 1 | 11 | 1 | 18 | 1 | 24 | 2 | 26 | 1 | 31 | 3 | 55 | 4 | 73 | 2 |
| AD-1729141.1 | 6 | 0 | 12 | 2 | 22 | 3 | 27 | 1 | 44 | 2 | 48 | 3 | 69 | 4 | 82 | 5 |
| AD-1725075.1 | 3 | 0 | 9 | 1 | 14 | 1 | 19 | 1 | 27 | 1 | 30 | 3 | 53 | 5 | 70 | 2 |
| AD-1727432.1 | 3 | 0 | 7 | 0 | 14 | 2 | 18 | 1 | 27 | 2 | 29 | 2 | 49 | 4 | 78 | 10 |
| AD-1729548.1 | 4 | 1 | 11 | 1 | 21 | 2 | 29 | 2 | 36 | 2 | 37 | 2 | 61 | 4 | 75 | 5 |
| AD-1725476.1 | 4 | 1 | 9 | 1 | 13 | 2 | 18 | 0 | 33 | 1 | 34 | 0 | 57 | 3 | 70 | 2 |
| AD-1729841.1 | 4 | 1 | 10 | 1 | 15 | 2 | 19 | 1 | 40 | 1 | 40 | 2 | 62 | 4 | 74 | 6 |
| AD-1725763.1 | 2 | 1 | 7 | 0 | 12 | 2 | 14 | 2 | 16 | 3 | 18 | 1 | 33 | 2 | 57 | 3 |
| AD-1725777.1 | 2 | 1 | 9 | 1 | 17 | 2 | 21 | 2 | 29 | 1 | 35 | 1 | 58 | 2 | 71 | 3 |
| AD-1728276.1 | 4 | 0 | 8 | 1 | 13 | 1 | 16 | 0 | 24 | 1 | 27 | 0 | 49 | 2 | 70 | 8 |
| AD-1730167.1 | 3 | 1 | 8 | 1 | 13 | 2 | 17 | 1 | 25 | 1 | 29 | 2 | 50 | 1 | 75 | 6 |
| AD-1726937.1 | 2 | 1 | 7 | 1 | 11 | 2 | 17 | 2 | 21 | 1 | 24 | 1 | 47 | 3 | 73 | 4 |
| AD-1724725.1 | 3 | 0 | 8 | 1 | 15 | 2 | 21 | 1 | 23 | 1 | 28 | 1 | 51 | 1 | 73 | 3 |
| AD-1727292.1 | 3 | 0 | 6 | 0 | 12 | 2 | 16 | 2 | 29 | 0 | 31 | 2 | 49 | 2 | 69 | 3 |
| AD-1725095.1 | 2 | 1 | 5 | 1 | 9 | 1 | 13 | 0 | 17 | 1 | 19 | 1 | 39 | 2 | 60 | 4 |
| AD-1725244.1 | 4 | 1 | 10 | 1 | 17 | 2 | 21 | 2 | 36 | 3 | 37 | 1 | 59 | 3 | 78 | 3 |
| AD-1725463.1 | 3 | 1 | 6 | 2 | 11 | 2 | 14 | 2 | 22 | 1 | 23 | 1 | 43 | 2 | 64 | 3 |
| AD-1729562.1 | 2 | 0 | 5 | 1 | 8 | 1 | 11 | 1 | 25 | 1 | 26 | 2 | 41 | 3 | 63 | 5 |
| AD-1725756.1 | 3 | 1 | 6 | 1 | 11 | 2 | 14 | 2 | 26 | 3 | 27 | 2 | 47 | 2 | 65 | 5 |
| AD-1725764.1 | 2 | 0 | 6 | 1 | 12 | 2 | 16 | 2 | 25 | 1 | 26 | 2 | 44 | 3 | 64 | 5 |
| AD-1730001.1 | 5 | 1 | 12 | 1 | 22 | 2 | 24 | 3 | 30 | 2 | 35 | 2 | 58 | 3 | 73 | 4 |
| AD-1726056.1 | 4 | 1 | 8 | 1 | 13 | 2 | 14 | 1 | 24 | 1 | 28 | 2 | 50 | 4 | 70 | 3 |
| AD-1726189.1 | 7 | 1 | 18 | 3 | 24 | 2 | 30 | 2 | 53 | 3 | 58 | 3 | 79 | 4 | 94 | 6 |
| AD-1724702.1 | 4 | 0 | 10 | 1 | 16 | 2 | 22 | 2 | 31 | 2 | 33 | 2 | 57 | 1 | 77 | 4 |
| AD-1724910.1 | 3 | 1 | 8 | 1 | 12 | 1 | 15 | 1 | 32 | 1 | 31 | 1 | 52 | 1 | 70 | 4 |
| AD-1727293.1 | 4 | 1 | 8 | 0 | 16 | 2 | 22 | 3 | 40 | 2 | 43 | 2 | 66 | 5 | 80 | 4 |
| AD-1725096.1 | 3 | 1 | 7 | 1 | 14 | 2 | 20 | 2 | 22 | 1 | 24 | 1 | 45 | 2 | 71 | 3 |
| AD-1729487.1 | 7 | 2 | 13 | 1 | 24 | 4 | 33 | 6 | 47 | 3 | 49 | 3 | 70 | 4 | 85 | 4 |
| AD-1725464.1 | 2 | 0 | 6 | 1 | 13 | 2 | 19 | 2 | 23 | 2 | 25 | 2 | 44 | 4 | 64 | 2 |
| AD-1727713.1 | 3 | 1 | 7 | 1 | 12 | 1 | 14 | 0 | 30 | 1 | 33 | 2 | 57 | 1 | 77 | 3 |
| AD-1725757.1 | 3 | 0 | 6 | 1 | 10 | 2 | 14 | 1 | 24 | 2 | 24 | 1 | 46 | 4 | 65 | 3 |
| AD-1727986.1 | 3 | 1 | 6 | 1 | 14 | 3 | 25 | 2 | 24 | 1 | 27 | 1 | 47 | 4 | 65 | 4 |
| AD-1725916.1 | 4 | 0 | 7 | 1 | 12 | 2 | 17 | 0 | 21 | 3 | 24 | 3 | 47 | 4 | 67 | 6 |
| AD-1728278.1 | 4 | 0 | 8 | 1 | 12 | 2 | 14 | 1 | 25 | 2 | 30 | 2 | 54 | 2 | 72 | 5 |
| AD-1726207.1 | 3 | 1 | 10 | 1 | 19 | 3 | 25 | 2 | 25 | 1 | 30 | 2 | 53 | 3 | 76 | 3 |
| AD-1726939.1 | 3 | 0 | 6 | 0 | 12 | 1 | 17 | 0 | 21 | 2 | 23 | 1 | 46 | 4 | 74 | 4 |
| AD-1725044.1 | 3 | 0 | 7 | 2 | 14 | 2 | 16 | 5 | 36 | 2 | 32 | 3 | 50 | 2 | 75 | 5 |
| AD-1725057.1 | 3 | 0 | 7 | 1 | 14 | 2 | 20 | 1 | 42 | 3 | 38 | 1 | 60 | 4 | 80 | 3 |
| AD-1725125.1 | 8 | 1 | 23 | 3 | 39 | 5 | 53 | 5 | 61 | 2 | 62 | 2 | 82 | 3 | 98 | 4 |
| AD-1725405.1 | 2 | 1 | 7 | 1 | 13 | 1 | 19 | 2 | 22 | 2 | 23 | 1 | 43 | 1 | 71 | 4 |
| AD-1725477.1 | 3 | 0 | 7 | 1 | 11 | 4 | 18 | 2 | 32 | 3 | 34 | 1 | 56 | 2 | 77 | 4 |
| AD-1727980.1 | 4 | 1 | 9 | 0 | 16 | 1 | 20 | 1 | 29 | 2 | 31 | 3 | 51 | 3 | 74 | 4 |
| AD-1725767.1 | 6 | 1 | 12 | 1 | 23 | 2 | 27 | 1 | 41 | 2 | 42 | 2 | 64 | 7 | 87 | 4 |
| AD-1730068.1 | 5 | 1 | 11 | 0 | 18 | 2 | 19 | 2 | 35 | 2 | 36 | 1 | 63 | 5 | 84 | 6 |
| AD-1730477.1 | 3 | 0 | 10 | 2 | 13 | 2 | 18 | 1 | 32 | 3 | 33 | 1 | 51 | 3 | 77 | 7 |

Example 4. In Vivo Screening of dsRNA Duplexes

Single Dose Study (1 mg/kg)

Duplexes of interest, identified from the above in vitro studies, were evaluated in vivo. In particular, at pre-dose day −21 wild-type mice (C57BL/6) were transduced with 2×10$^{11}$ viral particles of an adeno-associated virus 8 (AAV8) vector encoding human CFB intravenously via retro-orbital delivery. In particular, mice were administered an AAV8 encoding a portion of human CFB mRNA encoding the open reading frame and 3′ UTR of human CFB mRNA referenced as NM_001710.5, referred to as VCAV-07851.AAV8.HsCFB.

At day 0, groups of three mice were subcutaneously administered a single 1 mg/kg dose of the duplexes of interest or phosphate-buffered saline (PBS). Table 7 provides the treatment design and provides the duplexes of interest. On day 0 predose and day 7 post-dose, K$_2$EDTA plasma were collected and samples were analyzed for human CFB protein by ELISA (Assay Pro #EF7001). All plasma samples were diluted 1:1000 in 1× diluent and ELISA was conducted according to manufacturer's protocol. Data was interpolated using a 4-parameter logistic curve using GraphPad Prism software.

For all samples, human CFB protein levels were normalized to individual animals' day 0 level to calculate relative % human CFB protein remaining. For each group, the mean % CFB protein remaining was calculated (±standard deviation [SD]).

Figure 2:
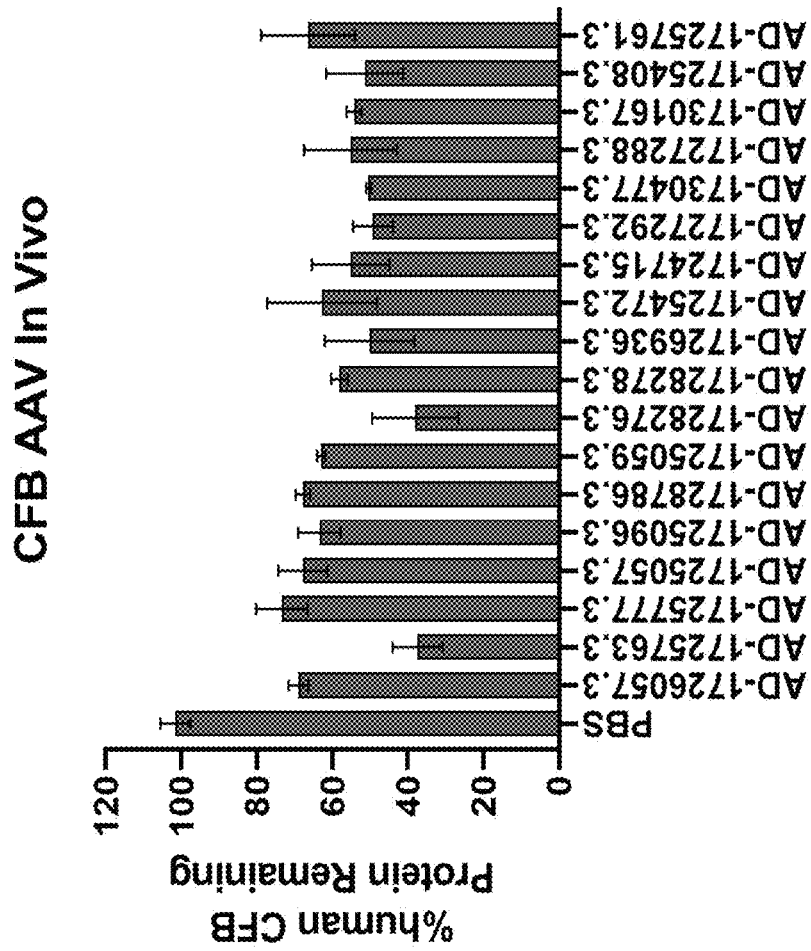
FIG. 2 is a graph depicting the level of human CFB protein in mice (n=3 per group) subcutaneously administered a single 1 mg/kg dose of the indicated dsRNA duplexes on day 7. Human CFB protein levels were shown relative to control levels determined with PBS treatment.

The data were expressed as percent of baseline value and presented as mean plus standard deviation. The results, listed in Table 8 and shown in FIG. 2, demonstrate that the exemplary duplex agents tested effectively reduce the level of the human CFB protein in vivo.

TABLE 7

Treatment Groups

| Group | Treatment | # of animals | Dose (mpk) | Target region |
|---|---|---|---|---|
| 1 | PBS | 3 | NA | |
| 2 | AD-1726057.3 | 3 | 1 | 2242-2264 |
| 3 | AD-1725763.3 | 3 | 1 | 1828-1850 |
| 4 | AD-1725777.3 | 3 | 1 | 1842-1864 |
| 5 | AD-1725057.3 | 3 | 1 | 995-1017 |
| 6 | AD-1725096.3 | 3 | 1 | 1034-1056 |
| 7 | AD-1728786.3 | 3 | 1 | 641-663 |
| 8 | AD-1725059.3 | 3 | 1 | 997-1019 |
| 9 | AD-1728276.3 | 3 | 1 | 2391-2413 |
| 10 | AD-1728278.3 | 3 | 1 | 2393-2415 |
| 11 | AD-1726936.3 | 3 | 1 | 640-662 |
| 12 | AD-1725472.3 | 3 | 1 | 1473-1495 |
| 13 | AD-1724715.3 | 3 | 1 | 504-526 |
| 14 | AD-1727292.3 | 3 | 1 | 1145-1167 |
| 15 | AD-1730477.3 | 3 | 1 | 2453-2475 |
| 17 | AD-1727288.3 | 3 | 1 | 1141-1163 |
| 18 | AD-1730167.3 | 3 | 1 | 2438-2460 |
| 19 | AD-1725408.3 | 3 | 1 | 1389-1411 |
| 20 | AD-1725761.3 | 3 | 1 | 1826-1848 |

TABLE 8

In Vivo Screen

| Group | Treatment | % CFB remaining (Individual animals) | | | Group Mean | STDEV |
|---|---|---|---|---|---|---|
| 1 | PBS | 100.01 | 106.18 | 98.65 | 101.61 | 4.01 |
| 2 | AD-1726057.3 | 67.11 | 72.07 | 68.00 | 69.06 | 2.64 |
| 3 | AD-1725763.3 | 35.75 | 44.82 | 31.92 | 37.50 | 6.63 |
| 4 | AD-1725777.3 | 80.87 | 67.57 | 72.06 | 73.50 | 6.77 |
| 5 | AD-1725057.3 | 60.58 | 72.93 | 70.28 | 67.93 | 6.50 |
| 6 | AD-1725096.3 | 68.25 | 57.34 | 65.02 | 63.54 | 5.61 |
| 7 | AD-1728786.3 | 68.9 | 65.6 | 69.2 | 67.91 | 1.99 |
| 8 | AD-1725059.3 | 62.9 | 62.2 | 64.2 | 63.10 | 0.99 |
| 9 | AD-1728276.3 | 49.2 | 26.3 | 38.7 | 38.06 | 11.43 |
| 10 | AD-1728278.3 | 60.5 | 56.1 | 58.1 | 58.24 | 2.16 |
| 11 | AD-1726936.3 | 38.4 | 62.2 | 50.0 | 50.21 | 11.92 |
| 12 | AD-1725472.3 | 47.5 | 76.4 | 64.5 | 62.78 | 14.53 |
| 13 | AD-1724715.3 | 51.69 | 47.15 | 66.83 | 55.23 | 10.30 |
| 14 | AD-1727292.3 | 43.51 | 50.53 | 53.90 | 49.31 | 5.30 |
| 15 | AD-1730477.3 | 50.08 | 50.96 | ND | 50.52 | 0.62 |
| 17 | AD-1727288.3 | 67.03 | 56.42 | 42.49 | 55.31 | 12.31 |
| 18 | AD-1730167.3 | 54.47 | 56.24 | 52.30 | 54.34 | 1.97 |
| 19 | AD-1725408.3 | 56.03 | 39.87 | 58.80 | 51.56 | 10.22 |
| 20 | AD-1725761.3 | 71.73 | 75.44 | 52.36 | 66.51 | 12.39 |

EQUIVALENTS

Those skilled in the art will recognize, or be able to ascertain using no more than routine experimentation, many equivalents to the specific embodiments and methods described herein. Such equivalents are intended to be encompassed by the scope of the following claims.

INFORMAL SEQUENCE LISTING

```
>gi|1732746151|ref|NM_001710.6 Homo sapiens
complement factor B (CFB), mRNA
```

SEQ ID NO: 1

GGGAAGGGAATGTGACCAGGTCTAGGTCTGGAGTTTCAGCTTGGACACTGAGCCAAGCAGACAAGCAAAG

CAAGCCAGGACACACCATCCTGCCCCAGGCCCAGCTTCTCTCCTGCCTTCCAACGCCATGGGGAGCAATC

TCAGCCCCCAACTCTGCCTGATGCCCTTTATCTTGGGCCTCTTGTCTGGAGGTGTGACCACCACTCCATG

GTCTTTGGCCCGGCCCCAGGGATCCTGCTCTCTGGAGGGGGTAGAGATCAAAGGCGGCTCCTTCCGACTT

CTCCAAGAGGGCCAGGCACTGGAGTACGTGTGTCCTTCTGGCTTCTACCCGTACCCTGTGCAGACACGTA

CCTGCAGATCTACGGGGTCCTGGAGCACCCTGAAGACTCAAGACCAAAAGACTGTCAGGAAGGCAGAGTG

CAGAGCAATCCACTGTCCAAGACCACACGACTTCGAGAACGGGGAATACTGGCCCCGGTCTCCCTACTAC

AATGTGAGTGATGAGATCTCTTTCCACTGCTATGACGGTTACACTCTCCGGGGCTCTGCCAATCGCACCT

-continued

```
GCCAAGTGAATGGCCGATGGAGTGGGCAGACAGCGATCTGTGACAACGGAGCGGGGTACTGCTCCAACCC

GGGCATCCCCATTGGCACAAGGAAGGTGGGCAGCCAGTACCGCCTTGAAGACAGCGTCACCTACCACTGC

AGCCGGGGGCTTACCCTGCGTGGCTCCCAGCGGCGAACGTGTCAGGAAGGTGGCTCTTGGAGCGGGACGG

AGCCTTCCTGCCAAGACTCCTTCATGTACGACACCCCTCAAGAGGTGGCCGAAGCTTTCCTGTCTTCCCT

GACAGAGACCATAGAAGGAGTCGATGCTGAGGATGGGCACGGCCCAGGGGAACAACAGAAGCGGAAGATC

GTCCTGGACCCTTCAGGCTCCATGAACATCTACCTGGTGCTAGATGGATCAGACAGCATTGGGGCCAGCA

ACTTCACAGGAGCCAAAAAGTGTCTAGTCAACTTAATTGAGAAGGTGGCAAGTTATGGTGTGAAGCCAAG

ATATGGTCTAGTGACATATGCCACATACCCCAAAATTTGGGTCAAAGTGTCTGAAGCAGACAGCAGTAAT

GCAGACTGGGTCACGAAGCAGCTCAATGAAATCAATTATGAAGACCACAAGTTGAAGTCAGGGACTAACA

CCAAGAAGGCCCTCCAGGCAGTGTACAGCATGATGAGCTGGCCAGATGACGTCCCTCCTGAAGGCTGGAA

CCGCACCCGCCATGTCATCATCCTCATGACTGATGGATTGCACAACATGGGCGGGACCCAATTACTGTC

ATTGATGAGATCCGGGACTTGCTATACATTGGCAAGGATCGCAAAAACCCAAGGGAGGATTATCTGGATG

TCTATGTGTTTGGGGTCGGGCCTTTGGTGAACCAAGTGAACATCAATGCTTTGGCTTCCAAGAAAGACAA

TGAGCAACATGTGTTCAAAGTCAAGGATATGGAAAACCTGGAAGATGTTTTCTACCAAATGATCGATGAA

AGCCAGTCTCTGAGTCTCTGTGGCATGGTTTGGGAACACAGGAAGGGTACCGATTACCACAAGCAACCAT

GGCAGGCCAAGATCTCAGTCATTCGCCCTTCAAAGGGACACGAGAGCTGTATGGGGGCTGTGGTGTCTGA

GTACTTTGTGCTGACAGCAGCACATTGTTTCACTGTGGATGACAAGGAACACTCAATCAAGGTCAGCGTA

GGAGGGGAGAAGCGGGACCTGGAGATAGAAGTAGTCCTATTTCACCCCAACTACAACATTAATGGGAAAA

AAGAAGCAGGAATTCCTGAATTTTATGACTATGACGTTGCCCTGATCAAGCTCAAGAATAAGCTGAAATA

TGGCCAGACTATCAGGCCCATTTGTCTCCCCTGCACCGAGGGAACAACTCGAGCTTTGAGGCTTCCTCCA

ACTACCACTTGCCAGCAACAAAAGGAAGAGCTGCTCCCTGCACAGGATATCAAAGCTCTGTTTGTGTCTG

AGGAGGAGAAAAAGCTGACTCGGAAGGAGGTCTACATCAAGAATGGGGATAAGAAAGGCAGCTGTGAGAG

AGATGCTAATATGCCCCAGGCTATGACAAAGTCAAGGACATCTCAGAGGTGGTCACCCCTCGGTTCCTT

TGTACTGGAGGAGTGAGTCCCTATGCTGACCCCAATACTTGCAGAGGTGATTCTGGCGGCCCCTTGATAG

TTCACAAGAGAAGTCGTTTCATTCAAGTTGGTGTAATCAGCTGGGGAGTAGTGGATGTCTGCAAAAACCA

GAAGCGGCAAAAGCAGGTACCTGCTCACGCCCGAGACTTTCACATCAACCTCTTTCAAGTGCTGCCCTGG

CTGAAGGAGAAACTCCAAGATGAGGATTTGGGTTTTCTATAAGGGGTTTCCTGCTGGACAGGGGCGTGGG

ATTGAATTAAAACAGCTGCGACAACA
```

>gi|218156288|ref|NM_008198.2|*Mus musculus* complement
factor B (Cfb), transcript variant 1, mRNA

SEQ ID NO: 2

```
GCTCCATCACACAGTCCATGGAAAGACTGATCTTTTAAATTGGGGGTAGTGGAGGTGGTGGTCTGTGCTT

GTTAGGAGGGGTCTGGGGGCTAAGAGGGAGCTTTGAAAGGGAAGTTCTGGCCCTTGGTCAGTCAAGGGTG

GGGCTCACATAGTTTCTGTTTCCTCAGTTGGCAGTTCAGCTGGGGCCCTCCTTCATGAATGTTCCGGGAA

GCAGTGGCTGCGTGCGCAGGGTAGGCTGGCCAGGCTGCAGATGCCAGAGCAGATTGCATAAAAGGTTAGG

GGACAGTGGGAAGGGGTGTAGCCAGATCCAGCATTTGGGTTTCAGTTTGGACAGGAGGTCAAATAGGCA

CCCAGAGTGACCTGGAGAGGGCTTTGGGCCACTGGACTCTCTGGTGCTTTCCATGACAATGGAGAGCCCC

CAGCTCTGCCTCGTCCTCTTGGTCTTAGGCTTCTCCTCTGGAGGTGTGAGCGCAACTCCAGTGCTTGAGG

CCCGGCCCCAAGTCTCCTGCTCTCTGGAGGGAGTAGAGATCAAAGGCGGCTCCTTTCAACTTCTCCAAGG

CGGTCAGGCCCTGGAGTACCTATGTCCCTCTGGCTTCTACCCATACCCCGTGCAGACTCGAACCTGCAGA

TCCACAGGCTCCTGGAGCGACCTGCAGACCCGAGACCAAAAGATTGTCCAGAAGGCGGAATGCAGAGCAA

TACGCTGCCCACGACCGCAGGACTTTGAAAATGGGGAATTCTGGCCCCGGTCCCCCTTCTACAACCTGAG
```

-continued

```
TGACCAGATTTCTTTTCAATGCTATGATGGTTACGTTCTCCGGGGCTCTGCTAATCGCACCTGCCAAGAG
AATGGCCGGTGGGATGGGCAAACAGCAATTTGTGATGATGGAGCTGGATACTGTCCCAATCCCGGTATTC
CTATTGGGACAAGGAAGGTGGGTAGCCAATACCGCCTTGAAGACATTGTTACTTACCACTGCAGCCGGGG
ACTTGTCCTGCGTGGCTCCCAGAAGCGAAAGTGTCAAGAAGGTGGCTCATGGAGTGGGACAGAGCCTTCC
TGCCAAGATTCCTTCATGTATGACAGCCCTCAAGAAGTGGCCGAAGCATTCCTATCCTCCCTGACAGAGA
CCATCGAAGGAGCCGATGCTGAGGATGGGCACAGCCCAGGAGAACAGCAGAAGAGGAAGATTGTCCTAGA
CCCCTCGGGCTCCATGAATATCTACCTGGTGCTAGATGGATCAGACAGCATCGGAAGCAGCAACTTCACA
GGGGCTAAGCGGTGCCTCACCAACTTGATTGAGAAGGTGGCGAGTTACGGGGTGAGGCCACGATATGGTC
TCCTGACATATGCTACAGTCCCCAAAGTGTTGGTCAGAGTGTCTGATGAGAGGAGTAGCGATGCCGACTG
GGTCACAGAGAAGCTCAACCAAATCAGTTATGAAGACCACAAGCTGAAGTCAGGGACCAACACCAAGAGG
GCTCTCCAGGCTGTGTATAGCATGATGAGCTGGGCAGGGATGCCCCGCCTGAAGGCTGGAATAGAACCC
GCCATGTCATCATCATTATGACTGATGGCTTGCACAACATGGGTGGAAACCCTGTCACTGTCATTCAGGA
CATCCGAGCCTTGCTGGACATCGGCAGGGATCCCAAAAATCCCAGGGAGGATTACCTGGATGTGTATGTG
TTTGGGGTCGGGCCTCTGGTGGACTCCGTGAACATCAATGCCTTAGCTTCCAAAAAGGACAATGAGCATC
ATGTGTTTAAAGTCAAGGATATGGAAGACCTGGAGAATGTTTTCTACCAAATGATTGATGAAACCAAATC
TCTGAGTCTCTGTGGCATGGTGTGGGAGCATAAAAAAGGCAACGATTATCATAAGCAACCATGGCAAGCC
AAGATCTCAGTCACTCGCCCTCTGAAAGGACATGAGACCTGTATGGGGCCGTGGTGTCTGAGTACTTCG
TGCTGACAGCAGCGCACTGCTTCATGGTGGATGATCAGAAACATTCCATCAAGGTCAGCGTGGGGGGTCA
GAGGCGGGACCTGGAGATTGAAGAGGTCCTGTTCCACCCCAAATACAATATTAATGGGAAAAAGGCAGAA
GGGATCCCTGAGTTCTATGATTATGATGTGGCCCTAGTCAAGCTCAAGAACAAGCTCAAGTATGGCCAGA
CTCTCAGGCCCATCTGTCTCCCCTGCACGGAGGGAACCACACGAGCCTTGAGGCTTCCTCAGACAGCCAC
CTGCAAGCAGCACAAGGAACAGTTGCTCCCTGTGAAGGATGTCAAAGCTCTGTTTGTATCTGAGCAAGGG
AAGAGCCTGACTCGGAAGGAGGTGTACATCAAGAATGGGGACAAGAAAGCCAGTTGTGAGAGAGATGCTA
CAAAGGCCCAAGGCTATGAGAAGGTCAAAGATGCCTCTGAGGTGGTCACTCCACGGTTCCTCTGCACAGG
AGGGGTGGATCCCTATGCTGACCCCAACACATGCAAAGGAGATTCCGGGGGCCCTCTCATTGTTCACAAG
AGAAGCCGCTTCATTCAAGTTGGTGTGATTAGCTGGGGAGTAGTAGATGTCTGCAGAGACCAGAGGCGGC
AACAGCTGGTACCCTCTTATGCCCGGGACTTCCACATCAACCTCTTCCAGGTGCTGCCCTGGCTAAAGGA
CAAGCTCAAAGATGAGGATTTGGGTTTTCTATAAAGAGCTTCCTGCAGGGAGAGTGTGAGGACAGATTAA
AGCAGTTACAATAACAAAAAAAAAAAAAAAAAAAAAAA
>gi|218156290|ref|NM_001142706.1 Mus musculus complement
factor B (Cfb), transcript variant 2, mRNA
                                                       SEQ ID NO: 3
GCTCCATCACACAGTCCATGGAAAGACTGATCTTTTAAATTGGGGGTAGTGGAGGTGGTGGTCTGTGCTT
GTTAGGAGGGGTCTGGGGGCTAAGAGGGAGCTTTGAAAGGGAAGTTCTGGCCCTTGGTCAGTCAAGGGTG
GGGCTCACATAGTTTCTGTTTCCTCAGTTGGCAGTTCAGCTGGGGCCCTCCTTCATGAATGTTCCGGGAA
GCAGTGGCTGCGTGCGCAGGGTAGGCTGGCCAGGCTGCAGATGCCAGAGCAGATTGCATAAAAGGTTAGG
GGACAGTGGGAAGGGGTGTAGCCAGATCCAGCATTTGGGTTTCAGTTTGGACAGGAGGTCAAATAGGCA
CCCAGAGTGACCTGGAGAGGGCTTTGGGCCACTGGACTCTCTGGTGCTTTCCATGACAATGGAGAGCCCC
CAGCTCTGCCTCGTCCTCTTGGTCTTAGGCTTCTCCTCTGGAGGTGTGAGCGCAACTCCAGTGCTTGAGG
CCCGGCCCCAAGTCTCCTGCTCTCTGGAGGGAGTAGAGATCAAAGGCGGCTCCTTTCAACTTCTCCAAGG
CGGTCAGGCCCTGGAGTACCTATGTCCCTCTGGCTTCTACCCATACCCCGTGCAGACTCGAACCTGCAGA
TCCACAGGCTCCTGGAGCGACCTGCAGACCCGAGACCAAAAGATTGTCCAGAAGGCGGAATGCAGAGCAA
```

-continued

```
TACGCTGCCCACGACCGCAGGACTTTGAAAATGGGGAATTCTGGCCCCGGTCCCCCTTCTACAACCTGAG

TGACCAGATTTCTTTTCAATGCTATGATGGTTACGTTCTCCGGGGCTCTGCTAATCGCACCTGCCAAGAG

AATGGCCGGTGGGATGGGCAAACAGCAATTTGTGATGATGGAGCTGGATACTGTCCCAATCCCGGTATTC

CTATTGGGACAAGGAAGGTGGGTAGCCAATACCGCCTTGAAGACATTGTTACTTACCACTGCAGCCGGGG

ACTTGTCCTGCGTGGCTCCCAGAAGCGAAAGTGTCAAGAAGGTGGCTCATGGAGTGGGACAGAGCCTTCC

TGCCAAGATTCCTTCATGTATGACAGCCCTCAAGAAGTGGCCGAAGCATTCCTATCCTCCCTGACAGAGA

CCATCGAAGGAGCCGATGCTGAGGATGGGCACAGCCCAGGAGAACAGCAGAAGAGGAAGATTGTCCTAGA

CCCCTCGGGCTCCATGAATATCTACCTGGTGCTAGATGGATCAGACAGCATCGGAAGCAGCAACTTCACA

GGGGCTAAGCGGTGCCTCACCAACTTGATTGAGAAGGTGGCGAGTTACGGGGTGAGGCCACGATATGGTC

TCCTGACATATGCTACAGTCCCCAAAGTGTTGGTCAGAGTGTCTGATGAGAGGAGTAGCGATGCCGACTG

GGTCACAGAGAAGCTCAACCAAATCAGTTATGAAGACCACAAGCTGAAGTCAGGGACCAACACCAAGAGG

GCTCTCCAGGCTGTGTATAGCATGATGAGCTGGGCAGGGGATGCCCCGCCTGAAGGCTGGAATAGAACCC

GCCATGTCATCATCATTATGACTGATGGCTTGCACAACATGGGTGGAAACCCTGTCACTGTCATTCAGGA

CATCCGAGCCTTGCTGGACATCGGCAGGGATCCCAAAAATCCCAGGGAGGATTACCTGGATGTGTATGTG

TTTGGGGTCGGGCCTCTGGTGGACTCCGTGAACATCAATGCCTTAGCTTCCAAAAAGGACAATGAGCATC

ATGTGTTTAAAGTCAAGGATATGGAAGACCTGGAGAATGTTTTCTACCAAATGATTGATGAAACCAAATC

TCTGAGTCTCTGTGGCATGGTGTGGGAGCATAAAAAAGGCAACGATTATCATAAGCAACCATGGCAAGCC

AAGATCTCAGTCACTCGCCCTCTGAAAGGACATGAGACCTGTATGGGGCCGTGGTGTCTGAGTACTTCG

TGCTGACAGCAGCGCACTGCTTCATGGTGGATGATCAGAAACATTCCATCAAGGTCAGCGTGGGGGGTCA

GAGGCGGGACCTGGAGATTGAAGAGGTCCTGTTCCACCCCAAATACAATATTAATGGGAAAAAGGCAGAA

GGGATCCCTGAGTTCTATGATTATGATGTGGCCCTAGTCAAGCTCAAGAACAAGCTCAAGTATGGCCAGA

CTCTCAGGCCCATCTGTCTCCCCTGCACGGAGGGAACCACACGAGCCTTGAGGCTTCCTCAGACAGCCAC

CTGCAAGCAGCACAAGGAACAGTTGCTCCCTGTGAAGGATGTCAAAGCTCTGTTTGTATCTGAGCAAGGG

AAGAGCCTGACTCGGAAGGAGGTGTACATCAAGAATGGGGACAAGCCAGTTGTGAGAGAGATGCTACAAA

GGCCCAAGGCTATGAGAAGGTCAAAGATGCCTCTGAGGTGGTCACTCCACGGTTCCTCTGCACAGGAGGG

GTGGATCCCTATGCTGACCCCAACACATGCAAAGGAGATTCCGGGGGCCCTCTCATTGTTCACAAGAGAA

GCCGCTTCATTCAAGTTGGTGTGATTAGCTGGGGAGTAGTAGATGTCTGCAGAGACCAGAGGCGGCAACA

GCTGGTACCCTCTTATGCCCGGGACTTCCACATCAACCTCTTCCAGGTGCTGCCCTGGCTAAAGGACAAG

CTCAAAGATGAGGATTTGGGTTTTCTATAAAGAGCTTCCTGCAGGGAGAGTGTGAGGACAGATTAAAGCA

GTTACAATAACAAAAAAAAAAAAAAAAAAAAAA
```

>gi|218156284|ref|NM_212466.3 *Rattus norvegicus* complement
factor B (Cfb), mRNA

SEQ ID NO: 4

```
CAGCAGGGGCCCTCCTTCATGAATGTTCCGGGAAGCAGCGTCTGTGCAGGGTAGGTTGGCCAGGCTGCAG

GTGCCAGAGCAGATTGCATAAAAGGTTAGGGGCCGGTGGGAAAGGGGTGTAGCCAGATCCAGCACTGGAG

TTTCAGTCTGGACAGCAAGTCAAGTAGCCACCCAGAGTGAACTGGAAAGGGCTTTTGGCCACGGGCTTTC

CATGACAATGGAGGGTCCCCAGCTCTGCTTAGTCCTCTTGGTCTTAGGCCTCTCCTCCGGAGGTGTGAGC

GCAACTCCAGTGCTTGAGGCCCGGCCCCAGGTCTCTTGCTCTCTGGAGGGAGTAGAGATCAAAGGCGGCT

CCTTCCAACTTCTCCAAGACGGTCAGGCCCTGGAGTACCTGTGTCCCTCTGGCTTCTACCCATACCCTGT

GCAGACTCGAACCTGCAAATCCACAGGCTCCTGGAGTGTCCTCCAGACCCGGGACCAAAAGATTGTCAAG

AAGGCAGAATGCAGAGCAATACGCTGCCCACGACCACAGGACTTTGAAAATGGGGAGTTCTGGCCCCGGT

CCCCCTACTACAACCTGAGTGATCAGATTTCTTTTCAATGCTATGATGGCTACACTCTCCGGGGCTCTGC
```

-continued

```
TAATCGCACCTGCCAAGAGAATGGCCGGTGGGATGGGCAAACAGCAATCTGTGATGATGGAGCGGGATAC

TGTCCCAACCCGGGTATTCCTATTGGGACAAGGAAGGTGGGAAGCCAGTACCGTCTTGAAGACACTGTCA

CTTACCACTGTAGTCGGGGACTTGTCCTACGTGGCTCCCAGCAGCGAAGGTGCCAGGAAGGTGGCTCGTG

GAGTGGGACAGAGCCTTCCTGCCAAGATTCCTTCATGTACGACAGCCCTCAAGAGGTGGCCGAAGCATTT

CTATCCTCCCTGACAGAGACCATCGAAGGAGCAGATGCGGAGGATGGGCACAGCCCAGGGGAACAGCAGA

AGAGGAAGATTATCCTGGACCCCTCGGGCTCCATGAATATCTACATGGTGCTGGATGGATCCGACAGCAT

CGGGGCCAGCAACTTCACAGGGGCCAAGCGGTGTCTCGCCAACTTGATTGAGAAGGTGGCGAGTTATGGG

GTGAAGCCAAGATACGGTCTAGTGACATATGCCACAGTCCCCAAAGTCTTGGTCAGAGTGTCTGAGGAGA

GGAGTAGTGATGCCGACTGGGTCACAGAGAAGCTCAACCAAATCAGTTATGAAGACCACAAGCTGAAGTC

AGGGACCAACACCAAGAAGGCTCTCCAGGCTGTATACAGCATGATGAGCTGGCCAGGGGATGCTCCGCCT

GAAGGCTGGAATCGAACCCGCCACGTCATCATCATCATGACTGATGGCTTGCACAACATGGGTGGAGACC

CTGTCACTGTCATTGAGGACATCCGAGACTTGCTGGATATTGGCAGGGATCGCAAAAATCCCCGGGAGGA

TTATTTGGATGTGTATGTGTTTGGGGTCGGGCCTCTGGTGGACCCTGTGAACATCAATGCCTTGGCTTCC

AAAAAGAACAATGAGCAGCATGTGTTCAAGGTCAAGGACATGGAGGATCTGGAGAACGTCTTCTACAAAA

TGATCGATGAAACCAAATCTCTGGGTCTCTGTGGCATGGTGTGGGAGCATCAGAAAGGCGGTGATTATTA

CAAGCAACCATGGCAAGCCAAGATCTCAGTCACTCGTCCTCTGAAAGGACATGAGAACTGTATGGGGGCC

GTGGTGTCCGAGTACTTCGTGCTGACAGCAGCGCATTGCTTCACAGTGGAAGATCAGAAACACTCCATCA

AGGTCAACGTGGAGGGGAAAAGGCGGGACCTGGAGATTGAAGAGGTCCTGTTCCACCCTAATTACGACAT

CAATGGGAAAAAGGCAGAAGGAATCTCTGAGTTCTATGACTATGATGTTGCCCTCATCAAGCTCAAGACC

AAGCTGAAGTACAGCCAGACTCTCAGGCCCATCTGTCTCCCCTGCACAGAGGGAACCACCCGAGCCTTGC

GGCTTCCTCAGACAGCCACCTGCAAACAGCACAAGGAAGAGTTGCTCCCTATGAAGGACGTCAAAGCTCT

GTTTGTATCCGAGGAAGGGAAGAAGCTGACCCGGAAGGAGGTGTACATCAAGAATGGGGAAAAGAAAGCC

AGTIGTGAGAGAGATGCTACAAAGGCCCAAGGCTATGAGAAGGTCAAAGTTGCCTCTGAGGTGGTCACCC

CCAGGTTCCTGTGCACCGGAGGGGTAGATCCCTATGCTGACCCCAACACATGCAAAGGAGACTCCGGGGG

CCCTCTCATTGTTCACAAGAGAAGCCGCTTCATTCAAGTTGGTGTGATCAGCTGGGGAGTAGTGGATGTC

TGCAAAGACCCGAGGCGGCAACAGTTGGTGCCCTCCTATGCCCGGGACTTCCACATCAATCTCTTCCAGG

TGCTGCCCTGGCTAAAGGAGAAGCTCAAAGACGAGGACTTGGGTTTCTTATAAGGAGCTTCCTGCTGGGA

GGGTGAGGGCAGATTAAAGCAGCTACAATACAAATACAAAAAAAAAAAAAAAAA

>gi|57114201|ref|NM_001009169.1|Pan troglodytes
complement factor B (CFB), mRNA
                                                         SEQ ID NO: 5
CCCAGGCCCAGCTTCTCTCCTGCCTTCCAACGCCATGGGGAGCAATCTCAGCCCCCAACTCTGCCTGATG

CCCTTCATCTTGGGCCTCTTGTCTGGAGGTGTGACCACCACTCCATGGCCTTTGGCCCAGCCCCAGGAAT

CCTGCTCTCTGAGGGGGTAGAGATCAAAGGCGGCTCCTTCCGACTTCTCCAAGAGGGCCAGGCACTGGA

GTACGTGTGTCCTTCTGGCTTCTACCCGTACCCTGTGCAGACACGTACCTGCAGATCTACGGGGTCCTGG

AGCACCCTGAAGACTCAAGTCCAAAAGACTGTCAGGAAGGCAGAGTGCAGAGCAATCCACTGTCCAAGAC

CACACGACTTCGAGAACGGGGAATACTGGCCCCGGTCTCCCTACTACAATGTGAGTGATGAGATCTCTTT

CCACTGCTATGACGGTTACACTCTCCGGGGCTCTGCCAATCGCACCTGCCAAGTGAATGGCCGGTGGAGT

GGGCAGACAGCGATCTGTGACAACGGAGCGGGGTACTGCTCCAACCCGGGCATCCCCATTGGCACAAGGA

AGGTGGGCAGCCAGTACCGCCTTGAAGACAGCGTCACCTACCACTGCAGCCGGGGGCTTACCCTGCGTGG

CTCCCAGCGGCGAACGTGTCAGGAAGGTGGCTCTTGGAGCGGGACGGAGCCTTCTTGCCAAGACTCCTTC

ATGTACGACACCCCTCAAGAGGTGGCCGAAGCTTTCCTGTCTTCCCTGACAGAGACCATAGAAGGAGTCG
```

```
ATGCTGAGGATGGGCACGGCCCAGGGGAACAACAGAAGCGGAAGATCGTCCTGGACCCTTCAGGCTCCAT

GAACATCTACCTGGTGCTAGATGGATCAGACAGCATTGGGGCCAGCAACTTCACAGGAGCCAAAAAGTGT

CTAGTCAACTTAATTGAGAAGGTGGCAAGTTATGGTGTGAAGCCAAGATATGGTCTAGTGACATATGCCA

CACACCCCAAAATTTGGGTCAAAGTGTCTGATCCAGACAGCAGTAATGCAGACTGGGTCACGAAGCAGCT

CAATGAAATCAATTATGAAGACCACAAGTTGAAGTCAGGGACTAACACCAAGAAGGCCCTCCAGGCAGTG

TACAGCATGATGAGCTGGCCAGATGACATCCCTCCTGAAGGCTGGAACCGCACCCGCCATGTCATCATCC

TCATGACTGATGGATTGCACAACATGGGCGGGGACCCAATTACTGTCATTGATGAGATCCGGGACTTGCT

ATACATTGGCAAGGATCGCAAAAACCCAAGGGAGGATTATCTGGATGTCTATGTGTTTGGGGTCGGGCCT

TTGGTGAACCAAGTGAACATCAATGCTTTGGCTTCCAAGAAAGACAATGAGCAACATGTGTTCAAAGTCA

AGGATATGGAAAACCTGGAAGATGTTTTCTACCAAATGATTGATGAAAGCCAGTCTCTGAGTCTCTGTGG

CATGGTTTGGGAACACAGGAAGGGTACCGATTACCACAAGCAACCATGGCAAGCCAAGATCTCAGTCATT

CGCCCTTCAAAGGGACACGAGAGCTGTATGGGGGCTGTGGTGTCTGAGTACTTTGTGCTGACAGCAGCAC

ACTGTTTCACTGTGGATGACAAGGAACACTCAATCAAGGTCAGCGTAGGAGGGGAGAAGCGGGACCTGGA

TATGACTATGACGTTGCCCTGATCAAGCTCAAGAATAAGCTGAAATATGGCCAGACTATCAGGCCCATTT

GTCTCCCCTGCACCGAGGGAACAACTCGAGCTTTGAGGCTTCCTCCAACTACCACTTGCCAGCAACAAAA

GGAAGAGCTGCTCCCTGCACAGGATATCAAAGCTCTGTTTGTGTCTGAGGAGGAGAAAAAGCTGACTCGG

AAGGAGGTCTACATCAAGAATGGGGATAAGAAAGGCAGCTGTGAGAGAGATGCTCAATATGCCCCAGGCT

ATGACAAAGTCAAGGACATCTCAGAGGTGGTCACCCCTCGGTTCCTTTGTACTGGAGGAGTGAGTCCCTA

TGCTGACCCCAATACTTGCAGAGGTGATTCTGGCGGCCCCTTGATAGTTCACAAAAGAAGTCGTTTCATT

CAAGTTGGTGTAATCAGCTGGGGAGTAGTGGATGTCTGCAAAAACCAGAAGCGGCAAAAGCAGGTACCTG

CTCACGCCCGAGACTTTCACATCAACCTCTTTCAAGTGCTGCCCTGGCTGAAGGAGAAACTCCAAGATGA

GGATTTGGGTTTTCTATAAGGGGT

Macaca fascicularis Complement Factor B
>ENSMMUP00000000985 [mRNA] locus = scaffold3881:
47830:53620:-
                                                               SEQ ID NO: 6
ATGGGGAGCAGTCTCAGCCCCCAGCTCTACCTGATGCCCTTCATCTTGGGCCTCTTATCTGCAGGTGTGA

CCACCACTCCATTGTCTTCGGCCCAGCCTCAAGGATCCTGCTCTCTGGAGGGGGTAGAGATCAAAGGTGG

CTCCTTCCGACTTCTCCAAGAGGGCCAGGCACTGGAATACGTGTGTCCTTCTGGCTTCTACCCGTACCCT

GTGCAGACACGTACCTGCAGATCCACGGGGTCCTGGAGCACCCTGCAGACTCAAGATCGAAAAACTGTCA

AGAAGGCAGAGTGCAGAGCAATCCGCTGTCCACGACCACAGGACTTCGAGAACGGGGAATACCGGCCCCG

GTCTCCCTACTACAATGTGAGTGATGAGATCTCTTTCCACTGCTATGACGGTTACACTCTCCGGGGCTCT

GCCAATCGCACCTGCCAAGTGAATGGCCGGTGGAGTGGGCAGACAGCGATCTGTGACAACGGAGCGGGGT

ACTGCTCCAACCCAGGCATCCCCATTGGCACAAGGAAGGTGGGCAGCCGGTACCGCCTTGAAGACAGCGT

CACCTACCACTGCAGCCGGGGCTTACCCTGCGTGGCTCCCAGCGGCGAACATGTCAGGAAGGTGGCTCT

TGGAGCGGGACGGAGCCTTCCTGCCAAGACTCCTTCATGTACGACACCCCTCAAGAGGTGGCCGAAGCTT

TCCTGTCTTCCCTGACGGAGACCATAGAAGGAGTCGATGCCGAGGATGGGCACAGCCCAGGGGAACAACA

GAAGCGGAGGATCATCCTAGACCCTTCAGGCTCCATGAACATCTACCTGGTGCTAGATGGATCAGACAGC

ATTGGGGCCGGCAACTTCACAGGAGCCAAAAAGTGTCTAGTCAACTTAATTGAGAAGGTGGCAAGTTATG

GTGTGAAGCCAAGATATGCTCTAGTGACATATGCCACATACCCCAGAATTTGGGTCAAAGTGTCTGACCA

AGAGAGCAGCAATGCAGACTGGGTCACGAAGAAGCTCAGTGAAATCAATTATGAAGACCACAAGTTGAAG

TCAGGGACTAACACCAAGAGGGCCCTCCAGGCAGTGTACAGCATGATGAGTTGGCCAGAGGACATCCCTC
```

-continued

CTGAAGGCTGGAACCGCACCCGCCATGTCATCATCCTCATGACCGATGGATTGCACAACATGGGCGGGGA

CCCAATTACTGTCATTGATGAGATCCGGGACTTGTTATACATCGGCAAGGATCGTAAAAACCCGAGGGAG

GATTATCTGGATGTCTATGTGTTTGGGGTTGGACCTTTGGTGGACCAAGTGAACATCAATGCTTTGGCTT

CCAAGAAAGACAATGAGCAACATGTGTTCAAAGTCAAGGATATGGAAAACCTGGAAGACGTTTTCTTCCA

AATGATTGATGAAAGCCAGTCTCTGAGTCTCTGTGGCATGGTTTGGGAACACACGACGGGTACCGATTAC

CACAAGCAACCATGGCAGGCCAAGATCTCAGTCACTCGCCCTTCGAAGGGACATGAGAGCTGTATGGGGG

CTGTGGTGTCTGAGTACTTTGTGCTGACAGCAGCACATTGTTTTACTGTGGACGACAAGGAACACTCGAT

CAAGGTCAGCGTGGGGAAGAAGCGGGACCTGGAGATAGAAAAAGTCCTATTTCACCCCGACTACAACATT

AGCGGGAAAAAGAAGCAGGAATTCCTGAATTTTATGACTATGACGTTGCCCTGATCAAGCTCAAGAATA

AGTTGAATTATGACCCGACTATCAGGCCCATTTGTCTCCCCTGCACCGAGGGAACAACTCGAGCTTTGAG

GCTTCCTCCAACTACCACTTGCCAGCAACAGAAGGAAGAGCTGCTCCCTGCACAGGATATCAAAGCTCTG

TTTGTGTCTGAGGAGGAGAAGAAGCTGACTCGGAAGGAGGTCTACATCAAGAATGGGGATAAGAAAGGCA

GCTGTGAGAGAGATGCTCAATATGCCCCAGGCTATGACAAAGTCAAGGACATCTCCGAGGTGGTCACCCC

TCGGTTCCTTTGTACTGGAGGAGTGAGTCCCTATGCTGACCCCAATACTTGCAGAGGTGATTCTGGCGGC

CCCTTGATAGTTCACAAGAGAAGTCGTTTTATTCAAGTTGGTGTCATCAGCTGGGGAGTAGTGGATGTCT

GCAAAAACCAGAAGCGGCAAAAGCAGGTACCTGCTCACGCCCGAGACTTTCACGTCAACCTCTTCCAAGT

GCTGCCCTGGCTGAAGGAGAAACTCCAAGATGAGGATTTGGGTTTTCTC

>gi|544428919|ref|XM_005553440.1|PREDICTED:
Macaca fascicularis complement factor B (CFB),
transcript variant X1, mRNA
SEQ ID NO: 7
ATTTCTGGTCCCTAAGTGGGTGGTCTGGGCTTGTTGGGGAGGAGCTGAGGCCAGAAGGAGGTACTGAAGG

GGAGAGTCCTGGACCTTGGGCAGCAAAGGGTGGGACTTCTGCAGTTTCTGCTTCCTTGACTGGCAGCTCA

GCGGGGCCCTCCCGCTTGGATGTTCCGGGAAAGTGATGAGGGTAGGACAGGCGGGGCAAGCTGCAGGTGC

CAGAACACAGATTGCATAAAAGGCCGGGAGCTGGTGGGGGGCAGGGGAAGGGAATGTGACCAGGTCTAGG

TCTGGAGTTTCAGCTTGGACACTGAGCTAAGTAGACAAGCAAAACAAGCCAGGACACGCCATCCTGCCCC

AGGCCCAGCTTCTCTCCTGCCTTCTAACGCCATGGGGAGCAGTCTCAGCCCCCAGCTCTACCTGATGCCC

TTCATCTTGGGCCTCTTATCTGCAGGTGTGACCACCACTCCATTGTCTTCGGCCCAGCCTCAAGGATCCT

GCTCTCTGGAGGGGTAGAGATCAAAGGTGGCTCCTTCCGACTTCTCCAAGAGGGCCAGGCACTGGAATA

CGTGTGTCCTTCTGGCTTCTACCCGTACCCTGTGCAGACACGTACCTGCAGATCCACGGGGTCCTGGAGC

ACCCTGCAGACTCAAGATCGAAAAACTGTCAAGAAGGCAGAGTGCAGAGCAATCCGCTGTCCACGACCAC

AGGACTTCGAGAACGGGGAATACCGGCCCCGGTCTCCCTACTACAATGTGAGTGATGAGATCTCTTTCCA

CTGCTATGACGGTTACACTCTCCGGGGCTCTGCCAATCGCACCTGCCAAGTGAATGGCCGGTGGAGTGGG

CAGACAGCGATCTGTGACAACGGAGCGGGGTACTGCTCCAACCCAGGCATCCCCATTGGCACAAGGAAGG

TGGGCAGCCGGTACCGCCTTGAAGACAGCGTCACCTACCACTGCAGCCGGGGGCTTACCCTGCGTGGCTC

CCAGCGGCGAACGTGTCAGGAAGGTGGCTCTTGGAGCGGGACGGAGCCTTCCTGCCAAGACTCCTTCATG

TACGACACCCCTCAAGAGGTGGCCGAAGCTTTCCTGTCTTCCCTGACGGAGACCATAGAAGGAGTCGATG

CCGAGGATGGGCACAGCCCAGGGGAACAACAGAAGCGGAGGATCATCCTAGACCCTTCAGGCTCCATGAA

CATCTACCTGGTGCTAGATGGATCAGACAGCATTGGGGCCGGCAACTTCACAGGAGCCAAAAAGTGTCTA

GTCAACTTAATTGAGAAGGTGGCAAGTTATGGTGTGAAGCCAAGATATGCTCTAGTGACATATGCCACAT

ACCCCAGAATTTGGGTCAAAGTGTCTGACCAAGAGAGCAGCAATGCAGACTGGGTCACGAAGAAGCTCAG

TGAAATCAATTATGAAGACCACAAGTTGAAGTCAGGGACTAACACCAAGAGGGCCCTCCAGGCAGTGTAC

AGCATGATGAGTTGGCCAGAGGACATCCCTCCTGAAGGCTGGAACCGCACCCGCCATGTCATCATCCTCA

-continued

TGACCGATGGATTGCACAACATGGGCGGGGACCCAATTACTGTCATTGATGAGATCCGGGACTTGTTATA

CATCGGCAAGGATCGCAAAAACCCGAGGGAGGATTATCTGGATGTCTATGTGTTTGGGGTTGGACCTTTG

GTGGACCAAGTGAACATCAATGCTTTGGCTTCCAAGAAAGACAATGAGCAACATGTGTTCAAAGTCAAGG

ATATGGAAAACCTGGAAGACGTTTTCTTCCAAATGATTGATGAAAGCCAGTCTCTGAGTCTCTGTGGCAT

GGTTTGGGAACACACGACGGGTACCGATTACCACAAGCAACCATGGCAGGCCAAGATCTCAGTCACTCGC

CCTTCGAAGGGACATGAGAGCTGTATGGGGGCTGTGGTGTCTGAGTACTTTGTGCTGACAGCAGCACATT

GTTTTACTGTGGACGACAAGGAACACTCGATCAAGGTCAGCGTGGGGAAGAAGCGGGACCTGGAGATAGA

AAAAGTCCTATTCACCCCGACTACAACATTAGCGGGAAAAAAGAAGCAGGAATTCCTGAATTTTATGAC

TATGACGTTGCCCTGATCAAGCTCAAGAAAAAGTTGAATTATGACCCGACTATCAGGCCCATTTGTCTCC

CCTGTACCGAGGGAACAACTCGAGCTTTGAGGCTTCCTCCAACTACCACTTGCCAGCAACAGAAGGAAGA

GCTGCTCCCTGCACAGGATATCAAAGCTCTGTTTGTGTCTGAGGAGGAGAAGAAGCTGACTCGGAAGGAG

GTCTACATCAAGAATGGGGATAAGAAAGGCAGCTGTGAGAGAGATGCTCAATATGCCCCAGGCTATGACA

AAGTCAAGGACATCTCGGAGGTGGTCACCCCTCGGTTCCTTTGTACTGGAGGAGTGAGTCCCTATGCTGA

CCCCAATACTTGCAGAGGTGATTCTGGCGGCCCCTTGATAGTTCACAAGAGAAGTCGTTTCATTCAAGTT

GGTGTCATCAGCTGGGGAGTAGTGGATGTCTGCAAAAACCAGAAGCGGCAAAAGCAGGTACCTGCTCACG

CCCGAGACTTTCACGTCAACCTCTTCCAAGTGCTGCCCTGGCTGAAGGAGAAACTCCAAGATGAGGATTT

GGGTTTTCTCTAAGGGGTTTCCTGCTGGACAGGGGCGCGGGATTGAATTAAAACAGCTGCGACAACA

Reverse Complement of SEQ ID NO: 1

SEQ ID NO: 8

TGTTGTCGCAGCTGTTTTAATTCAATCCCACGCCCCTGTCCAGCAGGAAACCCCTTATAGAAAACCCAAA

TCCTCATCTTGGAGTTTCTCCTTCAGCCAGGGCAGCACTTGAAAGAGGTTGATGTGAAAGTCTCGGGCGT

GAGCAGGTACCTGCTTTTGCCGCTTCTGGTTTTTGCAGACATCCACTACTCCCCAGCTGATTACACCAAC

TTGAATGAAACGACTTCTCTTGTGAACTATCAAGGGGCCGCCAGAATCACCTCTGCAAGTATTGGGGTCA

GCATAGGGACTCACTCCTCCAGTACAAAGGAACCGAGGGGTGACCACCTCTGAGATGTCCTTGACTTTGT

CATAGCCTGGGGCATATTGAGCATCTCTCTCACAGCTGCCTTTCTTATCCCCATTCTTGATGTAGACCTC

CTTCCGAGTCAGCTTTTTCTCCTCCTCAGACACAAACAGAGCTTTGATATCCTGTGCAGGGAGCAGCTCT

TCCTTTTGTTGCTGGCAAGTGGTAGTTGGAGGAAGCCTCAAAGCTCGAGTTGTTCCCTCGGTGCAGGGGA

GACAAATGGGCCTGATAGTCTGGCCATATTTCAGCTTATTCTTGAGCTTGATCAGGGCAACGTCATAGTC

ATAAAATTCAGGAATTCCTGCTTCTTTTTTCCCATTAATGTTGTAGTTGGGGTGAAATAGGACTACTTCT

ATCTCCAGGTCCCGCTTCTCCCCTCCTACGCTGACCTTGATTGAGTGTTCCTTGTCATCCACAGTGAAAC

AATGTGCTGCTGTCAGCACAAAGTACTCAGACACCACAGCCCCCATACAGCTCTCGTGTCCCTTTGAAGG

GCGAATGACTGAGATCTTGGCCTGCCATGGTTGCTTGTGGTAATCGGTACCCTTCCTGTGTTCCCAAACC

ATGCCACAGAGACTCAGAGACTGGCTTTCATCGATCATTTGGTAGAAAACATCTTCCAGGTTTTCCATAT

CCTTGACTTTGAACACATGTTGCTCATTGTCTTTCTTGGAAGCCAAAGCATTGATGTTCACTTGGTTCAC

CAAAGGCCCGACCCCAAACACATAGACATCCAGATAATCCTCCCTTGGGTTTTTGCGATCCTTGCCAATG

TATAGCAAGTCCCGGATCTCATCAATGACAGTAATTGGGTCCCCGCCCATGTTGTGCAATCCATCAGTCA

TGAGGATGATGACATGGCGGGTGCGGTTCCAGCCTTCAGGAGGGACGTCATCTGGCCAGCTCATCATGCT

GTACACTGCCTGGAGGGCCTTCTTGGTGTTAGTCCCTGACTTCAACTTGTGGTCTTCATAATTGATTTCA

TTGAGCTGCTTCGTGACCCAGTCTGCATTACTGCTGTCTGCTTCAGACACTTTGACCCAAATTTTGGGGT

ATGTGGCATATGTCACTAGACCATATCTTGGCTTCACACCATAACTTGCCACCTTCTCAATTAAGTTGAC

TAGACACTTTTTGGCTCCTGTGAAGTTGCTGGCCCCAATGCTGTCTGATCCATCTAGCACCAGGTAGATG

-continued

TTCATGGAGCCTGAAGGGTCCAGGACGATCTTCCGCTTCGTTGTTCCCCTGGGCCGTGCCCATCCTCAG

CATCGACTCCTTCTATGGTCTCTGTCAGGGAAGACAGGAAAGCTTCGGCCACCTCTTGAGGGGTGTCGTA

CATGAAGGAGTCTTGGCAGGAAGGCTCCGTCCCGCTCCAAGAGCCACCTTCCTGACACGTTCGCCGCTGG

GAGCCACGCAGGGTAAGCCCCCGGCTGCAGTGGTAGGTGACGCTGTCTTCAAGGCGGTACTGGCTGCCCA

CCTTCCTTGTGCCAATGGGGATGCCCGGGTTGGAGCAGTACCCCGCTCCGTTGTCACAGATCGCTGTCTG

CCCACTCCATCGGCCATTCACTTGGCAGGTGCGATTGGCAGAGCCCCGGAGAGTGTAACCGTCATAGCAG

TGGAAAGAGATCTCATCACTCACATTGTAGTAGGGAGACCGGGGCCAGTATTCCCCGTTCTCGAAGTCGT

GTGGTCTTGGACAGTGGATTGCTCTGCACTCTGCCTTCCTGACAGTCTTTTGGTCTTGAGTCTTCAGGGT

GCTCCAGGACCCCGTAGATCTGCAGGTACGTGTCTGCACAGGGTACGGGTAGAAGCCAGAAGGACACACG

TACTCCAGTGCCTGGCCCTCTTGGAGAAGTCGGAAGGAGCCGCCTTTGATCTCTACCCCCTCCAGAGAGC

AGGATCCCTGGGGCCGGGCCAAAGACCATGGAGTGGTGGTCACACCTCCAGACAAGAGGCCCAAGATAAA

GGGCATCAGGCAGAGTTGGGGGCTGAGATTGCTCCCCATGGCGTTGGAAGGCAGGAGAGAAGCTGGGCCT

GGGGCAGGATGGTGTGTCCTGGCTTGCTTTGCTTGTCTGCTTGGCTCAGTGTCCAAGCTGAAACTCCAGA

CCTAGACCTGGTCACATTCCCTTCCC

Reverse Complement of SEQ ID NO: 2
SEQ ID NO: 9
TTTTTTTTTTTTTTTTTTTTGTTATTGTAACTGCTTTAATCTGTCCTCACACTCTCCCTGCAGGAAGC

TCTTTATAGAAAACCCAAATCCTCATCTTTGAGCTTGTCCTTTAGCCAGGGCAGCACCTGGAAGAGGTTG

ATGTGGAAGTCCCGGGCATAAGAGGGTACCAGCTGTTGCCGCCTCTGGTCTCTGCAGACATCTACTACTC

CCCAGCTAATCACACCAACTTGAATGAAGCGGCTTCTCTTGTGAACAATGAGAGGGCCCCCGGAATCTCC

TTTGCATGTGTTGGGGTCAGCATAGGGATCCACCCCTCCTGTGCAGAGGAACCGTGGAGTGACCACCTCA

GAGGCATCTTTGACCTTCTCATAGCCTTGGGCCTTTGTAGCATCTCTCTCACAACTGGCTTTCTTGTCCC

CATTCTTGATGTACACCTCCTTCCGAGTCAGGCTCTTCCCTTGCTCAGATACAAACAGAGCTTTGACATC

CTTCACAGGGAGCAACTGTTCCTTGTGCTGCTTGCAGGTGGCTGTCTGAGGAAGCCTCAAGGCTCGTGTG

GTTCCCTCCGTGCAGGGGAGACAGATGGGCCTGAGAGTCTGGCCATACTTGAGCTTGTTCTTGAGCTTGA

CTAGGGCCACATCATAATCATAGAACTCAGGGATCCCTTCTGCCTTTTTCCCATTAATATTGTATTTGGG

GTGGAACAGGACCTCTTCAATCTCCAGGTCCCGCCTCTGACCCCCCACGCTGACCTTGATGGAATGTTTC

TGATCATCCACCATGAAGCAGTGCGCTGCTGTCAGCACGAAGTACTCAGACACCACGGCCCCCATACAGG

TCTCATGTCCTTTCAGAGGGCGAGTGACTGAGATCTTGGCTTGCCATGGTTGCTTATGATAATCGTTGCC

TTTTTTATGCTCCCACACCATGCCACAGAGACTCAGAGATTTGGTTTCATCAATCATTTGGTAGAAAACA

TTCTCCAGGTCTTCCATATCCTTGACTTTAAACACATGATGCTCATTGTCCTTTTTGGAAGCTAAGGCAT

TGATGTTCACGGAGTCCACCAGAGGCCCGACCCCAAACACATACACATCCAGGTAATCCTCCCTGGGATT

TTTGGGATCCCTGCCGATGTCCAGCAAGGCTCGGATGTCCTGAATGACAGTGACAGGGTTTCCACCCATG

TTGTGCAAGCCATCAGTCATAATGATGATGACATGGCGGTTCTATTCCAGCCTTCAGGCGGGGCATCCC

CTGCCCAGCTCATCATGCTATACACAGCCTGGAGAGCCCTCTTGGTGTTGGTCCCTGACTTCAGCTTGTG

GTCTTCATAACTGATTTGGTTGAGCTTCTCTGTGACCCAGTCGGCATCGCTACTCCTCTCATCAGACACT

CTGACCAACACTTTGGGGACTGTAGCATATGTCAGGAGACCATATCGTGGCCTCACCCCGTAACTCGCCA

CCTTCTCAATCAAGTTGGTGAGGCACCGCTTAGCCCCTGTGAAGTTGCTGCTTCCGATGCTGTCTGATCC

ATCTAGCACCAGGTAGATATTCATGGAGCCCGAGGGGTCTAGGACAATCTTCCTCTTCTGCTGTTCTCCT

GGGCTGTGCCCATCCTCAGCATCGGCTCCTTCGATGGTCTCTGTCAGGGAGGATAGGAATGCTTCGGCCA

CTTCTTGAGGGCTGTCATACATGAAGGAATCTTGGCAGGAAGGCTCTGTCCCACTCCATGAGCCACCTTC

TTGACACTTTCGCTTCTGGGAGCCACGCAGGACAAGTCCCCGGCTGCAGTGGTAAGTAACAATGTCTTCA

-continued

```
AGGCGGTATTGGCTACCCACCTTCCTTGTCCCAATAGGAATACCGGGATTGGGACAGTATCCAGCTCCAT

CATCACAAATTGCTGTTTGCCCATCCCACCGGCCATTCTCTTGGCAGGTGCGATTAGCAGAGCCCCGGAG

AACGTAACCATCATAGCATTGAAAAGAAATCTGGTCACTCAGGTTGTAGAAGGGGGACCGGGGCCAGAAT

TCCCCATTTTCAAAGTCCTGCGGTCGTGGGCAGCGTATTGCTCTGCATTCCGCCTTCTGGACAATCTTTT

GGTCTCGGGTCTGCAGGTCGCTCCAGGAGCCTGTGGATCTGCAGGTTCGAGTCTGCACGGGTATGGGTA

GAAGCCAGAGGGACATAGGTACTCCAGGGCCTGACCGCCTTGGAGAAGTTGAAAGGAGCCGCCTTTGATC

TCTACTCCCTCCAGAGAGCAGGAGACTTGGGGCCGGGCCTCAAGCACTGGAGTTGCGCTCACACCTCCAG

AGGAGAAGCCTAAGACCAAGAGGACGAGGCAGAGCTGGGGGCTCTCCATTGTCATGGAAAGCACCAGAGA

GTCCAGTGGCCCAAAGCCCTCTCCAGGTCACTCTGGGTGCCTATTTGACCTCCTGTCCAAACTGAAACCC

AAATGCTGGATCTGGCTACACCCCTTTCCCACTGTCCCCTAACCTTTTATGCAATCTGCTCTGGCATCTG

CAGCCTGGCCAGCCTACCCTGCGCACGCAGCCACTGCTTCCCGGAACATTCATGAAGGAGGGCCCCAGCT

GAACTGCCAACTGAGGAAACAGAAACTATGTGAGCCCCACCCTTGACTGACCAAGGGCCAGAACTTCCCT

TTCAAAGCTCCCTCTTAGCCCCCAGACCCCTCCTAACAAGCACAGACCACCACCTCCACTACCCCCAATT

TAAAAGATCAGTCTTTCCATGGACTGTGTGATGGAGC
```

Reverse Complement of SEQ ID NO: 3

SEQ ID NO: 10

```
TTTTTTTTTTTTTTTTTTTTGTTATTGTAACTGCTTTAATCTGTCCTCACACTCTCCCTGCAGGAAGC

TCTTTATAGAAAACCCAAATCCTCATCTTTGAGCTTGTCCTTTAGCCAGGGCAGCACCTGGAAGAGGTTG

ATGTGGAAGTCCCGGGCATAAGAGGGTACCAGCTGTTGCCGCCTCTGGTCTCTGCAGACATCTACTACTC

CCCAGCTAATCACACCAACTTGAATGAAGCGGCTTCTCTTGTGAACAATGAGAGGGCCCCCGGAATCTCC

TTTGCATGTGTTGGGGTCAGCATAGGGATCCACCCCTCCTGTGCAGAGGAACCGTGGAGTGACCACCTCA

GAGGCATCTTTGACCTTCTCATAGCCTTGGGCCTTTGTAGCATCTCTCTCACAACTGGCTTGTCCCCATT

CTTGATGTACACCTCCTTCCGAGTCAGGCTCTTCCCTTGCTCAGATACAAACAGAGCTTTGACATCCTTC

ACAGGGAGCAACTGTTCCTTGTGCTGCTTGCAGGTGGCTGTCTGAGGAAGCCTCAAGGCTCGTGTGGTTC

CCTCCGTGCAGGGGAGACAGATGGGCCTGAGAGTCTGGCCATACTTGAGCTTGTTCTTGAGCTTGACTAG

GGCCACATCATAATCATAGAACTCAGGGATCCCTTCTGCCTTTTTCCCATTAATATTGTATTTGGGGTGG

AACAGGACCTCTTCAATCTCCAGGTCCCGCCTCTGACCCCCCACGCTGACCTTGATGGAATGTTTCTGAT

CATCCACCATGAAGCAGTGCGCTGCTGTCAGCACGAAGTACTCAGACACCACGGCCCCCATACAGGTCTC

ATGTCCTTTCAGAGGGCGAGTGACTGAGATCTTGGCTTGCCATGGTTGCTTATGATAATCGTTGCCTTTT

TTATGCTCCCACACCATGCCACAGAGACTCAGAGATTIGGTTTCATCAATCATTTGGTAGAAAACATTCT

CCAGGTCTTCCATATCCTTGACTTTAAACACATGATGCTCATTGTCCTTTTTGGAAGCTAAGGCATTGAT

GTTCACGGAGTCCACCAGAGGCCCGACCCCAAACACATACACATCCAGGTAATCCTCCCTGGGATTTTTG

GGATCCCTGCCGATGTCCAGCAAGGCTCGGATGTCCTGAATGACAGTGACAGGGTTTCCACCCATGTTGT

GCAAGCCATCAGTCATAATGATGATGACATGGCGGGTTCTATTCCAGCCTTCAGGCGGGGCATCCCCTGC

CCAGCTCATCATGCTATACACAGCCTGGAGAGCCCTCTTGGTGTTGGTCCCTGACTTCAGCTTGTGGTCT

TCATAACTGATTTGGTTGAGCTTCTCTGTGACCCAGTCGGCATCGCTACTCCTCTCATCAGACACTCTGA

CCAACACTTTGGGGACTGTAGCATATGTCAGGAGACCATATCGTGGCCTCACCCCGTAACTCGCCACCTT

CTCAATCAAGTTGGTGAGGCACCGCTTAGCCCCTGTGAAGTTGCTGCTTCCGATGCTGTCTGATCCATCT

AGCACCAGGTAGATATTCATGGAGCCCGAGGGGTCTAGGACAATCTTCCTCTTCTGCTGTTCTCCTGGGC

TGTGCCCATCCTCAGCATCGGCTCCTTCGATGGTCTCTGTCAGGGAGGATAGGAATGCTTCGGCCACTTC

TTGAGGGCTGTCATACATGAAGGAATCTTGGCAGGAAGGCTCTGTCCCACTCCATGAGCCACCTTCTTGA
```

-continued

```
CACTTTCGCTTCTGGGAGCCACGCAGGACAAGTCCCCGGCTGCAGTGGTAAGTAACAATGTCTTCAAGGC

GGTATTGGCTACCCACCTTCCTTGTCCCAATAGGAATACCGGGATTGGGACAGTATCCAGCTCCATCATC

ACAAATTGCTGTTTGCCCATCCCACCGGCCATTCTCTTGGCAGGTGCGATTAGCAGAGCCCCGGAGAACG

TAACCATCATAGCATTGAAAAGAAATCTGGTCACTCAGGTTGTAGAAGGGGGACCGGGGCCAGAATTCCC

CATTTTCAAAGTCCTGCGGTCGTGGGCAGCGTATTGCTCTGCATTCCGCCTTCTGGACAATCTTTTGGTC

TCGGGTCTGCAGGTCGCTCCAGGAGCCTGTGGATCTGCAGGTTCGAGTCTGCACGGGGTATGGGTAGAAG

CCAGAGGGACATAGGTACTCCAGGGCCTGACCGCCTTGGAGAAGTTGAAAGGAGCCGCCTTTGATCTCTA

CTCCCTCCAGAGAGCAGGAGACTTGGGGCCGGGCCTCAAGCACTGGAGTTGCGCTCACACCTCCAGAGGA

GAAGCCTAAGACCAAGAGGACGAGGCAGAGCTGGGGGCTCTCCATTGTCATGGAAAGCACCAGAGAGTCC

AGTGGCCCAAAGCCCTCTCCAGGTCACTCTGGGTGCCTATTTGACCTCCTGTCCAAACTGAAACCCAAAT

GCTGGATCTGGCTACACCCCTTTCCCACTGTCCCCTAACCTTTTATGCAATCTGCTCTGGCATCTGCAGC

CTGGCCAGCCTACCCTGCGCACGCAGCCACTGCTTCCCGGAACATTCATGAAGGAGGGCCCCAGCTGAAC

TGCCAACTGAGGAAACAGAAACTATGTGAGCCCCACCCTTGACTGACCAAGGGCCAGAACTTCCCTTTCA

AAGCTCCCTCTTAGCCCCCAGACCCCTCCTAACAAGCACAGACCACCACCTCCACTACCCCCAATTTAAA

AGATCAGTCTTTCCATGGACTGTGTGATGGAGC
```

Reverse Complement of SEQ ID NO: 4

SEQ ID NO: 11

```
TTTTTTTTTTTTTTTGTATTTGTATTGTAGCTGCTTTAATCTGCCCTCACCCTCCCAGCAGGAAGCTCC

TTATAAGAAACCCAAGTCCTCGTCTTTGAGCTTCTCCTTTAGCCAGGGCAGCACCTGGAAGAGATTGATG

TGGAAGTCCCGGGCATAGGAGGGCACCAACTGTTGCCGCCTCGGGTCTTTGCAGACATCCACTACTCCCC

AGCTGATCACACCAACTTGAATGAAGCGGCTTCTCTTGTGAACAATGAGAGGGCCCCCGGAGTCTCCTTT

GCATGTGTTGGGGTCAGCATAGGGATCTACCCCTCCGGTGCACAGGAACCTGGGGGTGACCACCTCAGAG

GCAACTTTGACCTTCTCATAGCCTTGGGCCTTTGTAGCATCTCTCTCACAACTGGCTTTCTTTTCCCCAT

TCTTGATGTACACCTCCTTCCGGGTCAGCTTCTTCCCTTCCTCGGATACAAACAGAGCTTTGACGTCCTT

CATAGGGAGCAACTCTTCCTTGTGCTGTTTGCAGGTGGCTGTCTGAGGAAGCCGCAAGGCTCGGGTGGTT

CCCTCTGTGCAGGGGAGACAGATGGGCCTGAGAGTCTGGCTGTACTTCAGCTTGGTCTTGAGCTTGATGA

GGGCAACATCATAGTCATAGAACTCAGAGATTCCTTCTGCCTTTTTCCCATTGATGTCGTAATTAGGGTG

GAACAGGACCTCTTCAATCTCCAGGTCCCGCCTTTTCCCCTCCACGTTGACCTTGATGGAGTGTTTCTGA

TCTTCCACTGTGAAGCAATGCGCTGCTGTCAGCACGAAGTACTCGGACACCACGGCCCCCATACAGTTCT

CATGTCCTTTCAGAGGACGAGTGACTGAGATCTTGGCTTGCCATGGTTGCTTGTAATAATCACCGCCTTT

CTGATGCTCCCACACCATGCCACAGAGACCCAGAGATTTGGTTTCATCGATCATTTTGTAGAAGACGTTC

TCCAGATCCTCCATGTCCTTGACCTTGAACACATGCTGCTCATTGTTCTTTTTGGAAGCCAAGGCATTGA

TGTTCACAGGGTCCACCAGAGGCCCGACCCCAAACACATACACATCCAAATAATCCTCCCGGGGATTTTT

GCGATCCCTGCCAATATCCAGCAAGTCTCGGATGTCCTCAATGACAGTGACAGGGTCTCCACCCATGTTG

TGCAAGCCATCAGTCATGATGATGATGACGTGGCGGGTTCGATTCCAGCCTTCAGGCGGAGCATCCCCTG

GCCAGCTCATCATGCTGTATACAGCCTGGAGAGCCTTCTTGGTGTTGGTCCCTGACTTCAGCTTGTGGTC

TTCATAACTGATTTGGTTGAGCTTCTCTGTGACCCAGTCGGCATCACTACTCCTCTCCTCAGACACTCTG

ACCAAGACTTTGGGGACTGTGGCATATGTCACTAGACCGTATCTTGGCTTCACCCCATAACTCGCCACCT

TCTCAATCAAGTTGGCGAGACACCGCTTGGCCCCTGTGAAGTTGCTGGCCCCGATGCTGTCGGATCCATC

CAGCACCATGTAGATATTCATGGAGCCCGAGGGGTCCAGGATAATCTTCCTCTTCTGCTGTTCCCCTGGG

CTGTGCCCATCCTCCGCATCTGCTCCTTCGATGGTCTCTGTCAGGGAGGATAGAAATGCTTCGGCCACCT

CTTGAGGGCTGTCGTACATGAAGGAATCTTGGCAGGAAGGCTCTGTCCCACTCCACGAGCCACCTTCCTG
```

-continued

```
GCACCTTCGCTGCTGGGAGCCACGTAGGACAAGTCCCCGACTACAGTGGTAAGTGACAGTGTCTTCAAGA

CGGTACTGGCTTCCCACCTTCCTTGTCCCAATAGGAATACCCGGGTTGGGACAGTATCCCGCTCCATCAT

CACAGATTGCTGTTTGCCCATCCCACCGGCCATTCTCTTGGCAGGTGCGATTAGCAGAGCCCCGGAGAGT

GTAGCCATCATAGCATTGAAAAGAAATCTGATCACTCAGGTTGTAGTAGGGGACCGGGGCCAGAACTCC

CCATTTTCAAAGTCCTGTGGTCGTGGGCAGCGTATTGCTCTGCATTCTGCCTTCTTGACAATCTTTTGGT

CCCGGGTCTGGAGGACACTCCAGGAGCCTGTGGATTTGCAGGTTCGAGTCTGCACAGGGTATGGGTAGAA

GCCAGAGGGACACAGGTACTCCAGGGCCTGACCGTCTTGGAGAAGTTGGAAGGAGCCGCCTTTGATCTCT

ACTCCCTCCAGAGAGCAAGAGACCTGGGGCCGGGCCTCAAGCACTGGAGTTGCGCTCACACCTCCGGAGG

AGAGGCCTAAGACCAAGAGGACTAAGCAGAGCTGGGGACCCTCCATTGTCATGGAAAGCCCGTGGCCAAA

AGCCCTTTCCAGTTCACTCTGGGTGGCTACTTGACTTGCTGTCCAGACTGAAACTCCAGTGCTGGATCTG

GCTACACCCCTTTCCCACCGGCCCCTAACCTTTTATGCAATCTGCTCTGGCACCTGCAGCCTGGCCAACC

TACCCTGCACAGACGCTGCTTCCCGGAACATTCATGAAGGAGGGCCCCTGCTG
```

Reverse Complement of SEQ ID NO: 5

SEQ ID NO: 12

```
ACCCCTTATAGAAAACCCAAATCCTCATCTTGGAGTTTCTCCTTCAGCCAGGGCAGCACTTGAAAGAGGT

TGATGTGAAAGTCTCGGGCGTGAGCAGGTACCTGCTTTTGCCGCTTCTGGTTTTTGCAGACATCCACTAC

TCCCCAGCTGATTACACCAACTTGAATGAAACGACTTCTTTTGTGAACTATCAAGGGGCCGCCAGAATCA

CCTCTGCAAGTATTGGGGTCAGCATAGGGACTCACTCCTCCAGTACAAAGGAACCGAGGGGTGACCACCT

CTGAGATGTCCTTGACTTTGTCATAGCCTGGGGCATATTGAGCATCTCTCTCACAGCTGCCTTTCTTATC

CCCATTCTTGATGTAGACCTCCTTCCGAGTCAGCTTTTTCTCCTCCTCAGACACAAACAGAGCTTTGATA

TCCTGTGCAGGGAGCAGCTCTTCCTTTTGTTGCTGGCAAGTGGTAGTTGGAGGAAGCCTCAAAGCTCGAG

TTGTTCCCTCGGTGCAGGGGAGACAAATGGGCCTGATAGTCTGGCCATATTTCAGCTTATTCTTGAGCTT

GATCAGGGCAACGTCATAGTCATAAAATTCAGGAATTCCTGCTGCTTTTTTCCCATTAATGTTGTAGTTG

GGGTGAAATAGGACTACTTCTATCTCCAGGTCCCGCTTCTCCCCTCCTACGCTGACCTTGATTGAGTGTT

CCTTGTCATCCACAGTGAAACAGTGTGCTGCTGTCAGCACAAAGTACTCAGACACCACAGCCCCCATACA

GCTCTCGTGTCCCTTTGAAGGGCGAATGACTGAGATCTTGGCTTGCCATGGTTGCTTGTGGTAATCGGTA

CCCTTCCTGTGTTCCCAAACCATGCCACAGAGACTCAGAGACTGGCTTTCATCAATCATTTGGTAGAAAA

CATCTTCCAGGTTTTCCATATCCTTGACTTTGAACACATGTTGCTCATTGTCTTTCTTGAAGCCAAAGC

ATTGATGTTCACTTGGTTCACCAAAGGCCCGACCCCAAACACATAGACATCCAGATAATCCTCCCTTGGG

TTTTTGCGATCCTTGCCAATGTATAGCAAGTCCCGGATCTCATCAATGACAGTAATTGGGTCCCCGCCCA

TGTTGTGCAATCCATCAGTCATGAGGATGATGACATGGCGGGTGCGGTTCCAGCCTTCAGGAGGGATGTC

ATCTGGCCAGCTCATCATGCTGTACACTGCCTGGAGGGCCTTCTTGGTGTTAGTCCCTGACTTCAACTTG

TGGTCTTCATAATTGATTTCATTGAGCTGCTTCGTGACCCAGTCTGCATTACTGCTGTCTGGATCAGACA

CTTTGACCCAAATTTTGGGGTGTGTGGCATATGTCACTAGACCATATCTTGGCTTCACACCATAACTTGC

CACCTTCTCAATTAAGTTGACTAGACACTTTTTGGCTCCTGTGAAGTTGCTGGCCCCAATGCTGTCTGAT

CCATCTAGCACCAGGTAGATGTTCATGGAGCCTGAAGGGTCCAGGACGATCTTCCGCTTCTGTTGTTCCC

CTGGGCCGTGCCCATCCTCAGCATCGACTCCTTCTATGGTCTCTGTCAGGGAAGACAGGAAAGCTTCGGC

CACCTCTTGAGGGGTGTCGTACATGAAGGAGTCTTGGCAAGAAGGCTCCGTCCCGCTCCAAGAGCCACCT

TCCTGACACGTTCGCCGCTGGGAGCCACGCAGGGTAAGCCCCCGGCTGCAGTGGTAGGTGACGCTGTCTT

CAAGGCGGTACTGGCTGCCCACCTTCCTTGTGCCAATGGGGATGCCCGGGTTGGAGCAGTACCCCGCTCC

GTTGTCACAGATCGCTGTCTGCCCACTCCACCGGCCATTCACTTGGCAGGTGCGATTGGCAGAGCCCCGG
```

```
AGAGTGTAACCGTCATAGCAGTGGAAAGAGATCTCATCACTCACATTGTAGTAGGGAGACCGGGGCCAGT
ATTCCCCGTTCTCGAAGTCGTGTGGTCTTGGACAGTGGATTGCTCTGCACTCTGCCTTCCTGACAGTCTT
TTGGACTTGAGTCTTCAGGGTGCTCCAGGACCCCGTAGATCTGCAGGTACGTGTCTGCACAGGGTACGGG
TAGAAGCCAGAAGGACACACGTACTCCAGTGCCTGGCCCTCTTGGAGAAGTCGGAAGGAGCCGCCTTTGA
TCTCTACCCCCTCCAGAGAGCAGGATTCCTGGGGCTGGGCCAAAGGCCATGGAGTGGTGGTCACACCTCC
AGACAAGAGGCCCAAGATGAAGGGCATCAGGCAGAGTTGGGGGCTGAGATTGCTCCCCATGGCGTTGGAA
GGCAGGAGAGAAGCTGGGCCTGGG
```

Reverse Complement of SEQ ID NO: 6

SEQ ID NO: 13

```
GAGAAAACCCAAATCCTCATCTTGGAGTTTCTCCTTCAGCCAGGGCAGCACTTGGAAGAGGTTGACGTGA
AAGTCTCGGGCGTGAGCAGGTACCTGCTTTTGCCGCTTCTGGTTTTTGCAGACATCCACTACTCCCCAGC
TGATGACACCAACTTGAATAAAACGACTTCTCTTGTGAACTATCAAGGGGCCGCCAGAATCACCTCTGCA
AGTATTGGGGTCAGCATAGGGACTCACTCCTCCAGTACAAAGGAACCGAGGGGTGACCACCTCGGAGATG
TCCTTGACTTTGTCATAGCCTGGGGCATATTGAGCATCTCTCTCACAGCTGCCTTTCTTATCCCCATTCT
TGATGTAGACCTCCTTCCGAGTCAGCTTCTTCTCCTCCTCAGACACAAACAGAGCTTTGATATCCTGTGC
AGGGAGCAGCTCTTCCTTCTGTTGCTGGCAAGTGGTAGTTGGAGGAAGCCTCAAAGCTCGAGTTGTTCCC
TCGGTGCAGGGGAGACAAATGGGCCTGATAGTCGGGTCATAATTCAACTTATTCTTGAGCTTGATCAGGG
CAACGTCATAGTCATAAAATTCAGGAATTCCTGCTTCTTTTTTCCCGCTAATGTTGTAGTCGGGGTGAAA
TAGGACTTTTTCTATCTCCAGGTCCCGCTTCTTCCCCACGCTGACCTTGATCGAGTGTTCCTTGTCGTCC
ACAGTAAAACAATGTGCTGCTGTCAGCACAAAGTACTCAGACACCACAGCCCCCATACAGCTCTCATGTC
CCTTCGAAGGGCGAGTGACTGAGATCTTGGCCTGCCATGGTTGCTTGTGGTAATCGGTACCCGTCGTGTG
TTCCCAAACCATGCCACAGAGACTCAGAGACTGGCTTTCATCAATCATTTGGAAGAAAACGTCTTCCAGG
TTTTCCATATCCTTGACTTTGAACACATGTTGCTCATTGTCTTTCTTGGAAGCCAAAGCATTGATGTTCA
CTTGGTCCACCAAAGGTCCAACCCCAAACACATAGACATCCAGATAATCCTCCCTCGGGTTTTTACGATC
CTTGCCGATGTATAACAAGTCCCGGATCTCATCAATGACAGTAATTGGGTCCCCGCCCATGTTGTGCAAT
CCATCGGTCATGAGGATGATGACATGGCGGGTGCGGTTCCAGCCTTCAGGAGGGATGTCCTCTGGCCAAC
TCATCATGCTGTACACTGCCTGGAGGGCCCTCTTGGTGTTAGTCCCTGACTTCAACTTGTGGTCTTCATA
ATTGATTTCACTGAGCTTCTTCGTGACCCAGTCTGCATTGCTGCTCTCTTGGTCAGACACTTTGACCCAA
ATTCTGGGGTATGTGGCATATGTCACTAGAGCATATCTTGGCTTCACACCATAACTTGCCACCTTCTCAA
TTAAGTTGACTAGACACTTTTTGGCTCCTGTGAAGTTGCCGGCCCCAATGCTGTCTGATCCATCTAGCAC
CAGGTAGATGTTCATGGAGCCTGAAGGGTCTAGGATGATCCTCCGCTTCTGTTGTTCCCCTGGGCTGTGC
CCATCCTCGGCATCGACTCCTTCTATGGTCTCCGTCAGGGAAGACAGGAAAGCTTCGGCCACCTCTTGAG
GGGTGTCGTACATGAAGGAGTCTTGGCAGGAAGGCTCCGTCCCGCTCCAAGAGCCACCTTCCTGACATGT
TCGCCGCTGGGAGCCACGCAGGGTAAGCCCCCGGCTGCAGTGGTAGGTGACGCTGTCTTCAAGGCGGTAC
CGGCTGCCCACCTTCCTTGTGCCAATGGGGATGCCTGGGTTGGAGCAGTACCCCGCTCCGTTGTCACAGA
TCGCTGTCTGCCCACTCCACCGGCCATTCACTTGGCAGGTGCGATTGGCAGAGCCCCGGAGAGTGTAACC
GTCATAGCAGTGGAAAGAGATCTCATCACTCACATTGTAGTAGGGAGACCGGGGCCGGTATTCCCCGTTC
TCGAAGTCCTGTGGTCGTGGACAGCGGATTGCTCTGCACTCTGCCTTCTTGACAGTTTTTCGATCTTGAG
TCTGCAGGGTGCTCCAGGACCCCGTGGATCTGCAGGTACGTGTCTGCACAGGGTACGGGTAGAAGCCAGA
AGGACACACGTATTCCAGTGCCTGGCCCTCTTGGAGAAGTCGGAAGGAGCCACCTTTGATCTCTACCCCC
TCCAGAGAGCAGGATCCTTGAGGCTGGGCCGAAGACAATGGAGTGGTGGTCACACCTGCAGATAAGAGGC
CCAAGATGAAGGGCATCAGGTAGAGCTGGGGGCTGAGACTGCTCCCCAT
```

Reverse Complement of SEQ ID NO: 7

SEQ ID NO: 14

TGTTGTCGCAGCTGTTTTAATTCAATCCCGCGCCCCTGTCCAGCAGGAAACCCCTTAGAGAAAACCCAAA

TCCTCATCTTGGAGTTTCTCCTTCAGCCAGGGCAGCACTTGGAAGAGGTTGACGTGAAAGTCTCGGGCGT

GAGCAGGTACCTGCTTTTGCCGCTTCTGGTTTTTGCAGACATCCACTACTCCCCAGCTGATGACACCAAC

TTGAATGAAACGACTTCTCTTGTGAACTATCAAGGGGCCGCCAGAATCACCTCTGCAAGTATTGGGGTCA

GCATAGGGACTCACTCCTCCAGTACAAAGGAACCGAGGGGTGACCACCTCCGAGATGTCCTTGACTTTGT

CATAGCCTGGGGCATATTGAGCATCTCTCTCACAGCTGCCTTTCTTATCCCCATTCTTGATGTAGACCTC

CTTCCGAGTCAGCTTCTTCTCCTCCTCAGACACAAACAGAGCTTTGATATCCTGTGCAGGGAGCAGCTCT

TCCTTCTGTTGCTGGCAAGTGGTAGTTGGAGGAAGCCTCAAAGCTCGAGTTGTTCCCTCGGTACAGGGGA

GACAAATGGGCCTGATAGTCGGGTCATAATTCAACTTTTTCTTGAGCTTGATCAGGGCAACGTCATAGTC

ATAAAATTCAGGAATTCCTGCTTCTTTTTTCCCGCTAATGTTGTAGTCGGGGTGAAATAGGACTTTTTCT

ATCTCCAGGTCCCGCTTCTTCCCCACGCTGACCTTGATCGAGTGTTCCTTGTCGTCCACAGTAAAACAAT

GTGCTGCTGTCAGCACAAAGTACTCAGACACCACAGCCCCCATACAGCTCTCATGTCCCTTCGAAGGGCG

AGTGACTGAGATCTTGGCCTGCCATGGTTGCTTGTGGTAATCGGTACCCGTCGTGTGTTCCCAAACCATG

CCACAGAGACTCAGAGACTGGCTTTCATCAATCATTTGGAAGAAAACGTCTTCCAGGTTTTCCATATCCT

TGACTTTGAACACATGTTGCTCATTGTCTTTCTTGGAAGCCAAAGCATTGATGTTCACTTGGTCCACCAA

AGGTCCAACCCCAAACACATAGACATCCAGATAATCCTCCCTCGGGTTTTTGCGATCCTTGCCGATGTAT

AACAAGTCCCGGATCTCATCAATGACAGTAATTGGGTCCCCGCCCATGTTGTGCAATCCATCGGTCATGA

GGATGATGACATGGCGGGTGCGGTTCCAGCCTTCAGGAGGGATGTCCTCTGGCCAACTCATCATGCTGTA

CACTGCCTGGAGGGCCCTCTTGGTGTTAGTCCCTGACTTCAACTTGTGGTCTTCATAATTGATTTCACTG

AGCTTCTTCGTGACCCAGTCTGCATTGCTGCTCTCTTGGTCAGACACTTTGACCCAAATTCTGGGGTATG

TGGCATATGTCACTAGAGCATATCTTGGCTTCACACCATAACTTGCCACCTTCTCAATTAAGTTGACTAG

ACACTTTTTGGCTCCTGTGAAGTTGCCGGCCCCAATGCTGTCTGATCCATCTAGCACCAGGTAGATGTTC

ATGGAGCCTGAAGGGTCTAGGATGATCCTCCGCTTCTGTTGTTCCCCTGGGCTGTGCCCATCCTCGGCAT

CGACTCCTTCTATGGTCTCCGTCAGGGAAGACAGGAAAGCTTCGGCCACCTCTTGAGGGGTGTCGTACAT

GAAGGAGTCTTGGCAGGAAGGCTCCGTCCCGCTCCAAGAGCCACCTTCCTGACACGTTCGCCGCTGGGAG

CCACGCAGGGTAAGCCCCCGGCTGCAGTGGTAGGTGACGCTGTCTTCAAGGCGGTACCGGCTGCCCACCT

TCCTTGTGCCAATGGGATGCCTGGGTTGGAGCAGTACCCCGCTCCGTTGTCACAGATCGCTGTCTGCCC

ACTCCACCGGCCATTCACTTGGCAGGTGCGATTGGCAGAGCCCCGGAGAGTGTAACCGTCATAGCAGTGG

AAAGAGATCTCATCACTCACATTGTAGTAGGGAGACCGGGGCCGGTATTCCCCGTTCTCGAAGTCCTGTG

GTCGTGGACAGCGGATTGCTCTGCACTCTGCCTTCTTGACAGTTTTTCGATCTTGAGTCTGCAGGGTGCT

CCAGGACCCCGTGGATCTGCAGGTACGTGTCTGCACAGGGTACGGGTAGAAGCCAGAAGGACACACGTAT

TCCAGTGCCTGGCCCTCTTGGAGAAGTCGGAAGGAGCCACCTTTGATCTCTACCCCCTCCAGAGAGCAGG

ATCCTTGAGGCTGGGCCGAAGACAATGGAGTGGTGGTCACACCTGCAGATAAGAGGCCCAAGATGAAGGG

```
CATCAGGTAGAGCTGGGGGCTGAGACTGCTCCCCATGGCGTTAGAAGGCAGGAGAGAAGCTGGGCCTGGG

GCAGGATGGCGTGTCCTGGCTTGTTTTGCTTGTCTACTTAGCTCAGTGTCCAAGCTGAAACTCCAGACCT

AGACCTGGTCACATTCCCTTCCCCTGCCCCCCACCAGCTCCCGGCCTTTTATGCAATCTGTGTTCTGGCA

CCTGCAGCTTGCCCCGCCTGTCCTACCCTCATCACTTTCCCGGAACATCCAAGCGGGAGGGCCCCGCTGA

GCTGCCAGTCAAGGAAGCAGAAACTGCAGAAGTCCCACCCTTTGCTGCCCAAGGTCCAGGACTCTCCCCT

TCAGTACCTCCTTCTGGCCTCAGCTCCTCCCCAACAAGCCCAGACCACCCACTTAGGGACCAGAAAT
```

SEQUENCE LISTING (2777 sequences)

SEQ ID NO: 1 - DNA, 2476 bp, Homo sapiens
  source 1..2476: mol_type = genomic DNA
gggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccgatggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgacaaca

SEQ ID NO: 2 - DNA, 2767 bp, Mus musculus
  source 1..2767: mol_type = genomic DNA
gctccatcacacagtccatggaaagactgatcttttaaattgggggtagtggaggtggtggtctgtgcttgttaggaggggtctgggggctaagagggagctttgaaagggaagttctggcccttggtcagtcaagggtggggctcacatagtttctgtttcctcagttggcagttcagctggggccctccttcatgaatgttccgggaagcagtggctgcgtgcgcagggtaggctggccaggctgcagatgccagagcagattgcataaaaggttaggggacagtgggaaaggggtgtagccagatccagcatttgggtttcagtttggacaggaggtcaaataggcacccagagtgacctggagagggctttgggccactggactctctggtgctttccatgacaatggagagcccccagctctgcctcgtcctcttggtcttaggcttctcctctggaggtgtgagcgcaactccagtgcttgaggcccggccccaagtctcctgctctctggagggagtagagatcaaaggcggctcctttcaacttctccaaggcggtcaggccctggagtacctatgtccctctggcttctacccataccccgtgcagactcgaacctgcagatccacaggctcctggagcgacctgcagacccgagaccaaaagattgtccagaaggcggaatgcagagcaatacgctgcccacgaccgcaggactttgaaaatggggaattctggccccggtcccccttctacaacctgagtgaccagatttcttttcaatgctatgatggttacgttctccggggctctgctaatcgcacctgccaagagaatggccggtgggatgggcaaacagcaatttgtgatgatggagctggatactgtcccaatcccggtattcctattgggacaaggaaggtgggtagccaataccgccttgaagacattgttacttaccactgcagccggggacttgtcctgcgtggctcccagaagcgaaagtgtcaagaaggtggctcatggagtgggacagagccttcctgccaagattccttcatgtatgacagccctcaagaagtggccgaagcattcctatcctccctgacagagaccatcgaaggagccgatgctgaggatgggcacagcccaggagaacagcagaagaggaagattgtcctagacccctcgggctccatgaatatctacctggtgctagatggatcagacagcatcggaagcagcaacttcacaggggctaagcggtgcctcaccaacttgattgagaaggtggcgagttacggggtgaggccacgatatggtctcctgacatatgctacagtccccaaagtgttggtcagagtgtctgatgagaggagtagcgatgccgactgggtcacagagaagctcaaccaaatcagttatgaagaccacaagctgaagtcagggaccaacaccaagagggctctccaggctgtgtatagcatgatgagctgggcaggggatgccccgcctgaaggctggaatagaacccgccatgtcatcatcattatgactgatggcttgcacaacatgggtggaaaccctgtcactgtcattcaggacatccgagccttgctggacatcggcagggatcccaaaaatcccagggaggattacctggatgtgtatgtgtttggggtcgggcctctggtggactccgtgaacatcaatgccttagcttccaaaaaggacaatgagcatcatgtgtttaaagtcaaggatatggaagacctggagaatgttttctaccaaatgattgatgaaaccaaatctctgagtctctgtggcatggtgtgggagcataaaaaaggcaacgattatcataagcaaccatggcaagccaagatctcagtcactcgccctctgaaaggacatgagacctgtatgggggccgtggtgtctgagtacttcgtgctgacagcagcgcactgcttcatggtggatgatcagaaacattccatcaaggtcagcgtggggggtcagaggcgggacctggagattgaagaggtcctgttccaccccaaatacaatattaatgggaaaaaggcagaagggatccctgagttctatgattatgatgtggccctagtcaagctcaagaacaagctcaagtatggccagactctcaggcccatctgtctcccctgcacggagggaaccacacgagccttgaggcttcctcagacagccacctgcaagcagcacaaggaacagttgctccctgtgaaggatgtcaaagctctgtttgtatctgagcaagggaagagcctgactcggaaggaggtgtacatcaagaatggggacaagaaagccagttgtgagagagatgctacaaaggcccaaggctatgagaaggtcaaagatgcctctgaggtggtcactccacggttcctctgcacaggaggggtggatccctatgctgaccccaacacatgcaaaggagattccgggggccctctcattgttcacaagagaagccgcttcattcaagttggtgtgattagctggggagtagtagatgtctgcagagaccagaggcggcaacagctggtaccctcttatgcccgggacttccacatcaacctcttccaggtgctgccctggctaaaggacaagctcaaagatgaggatttgggttttctataaagagcttcctgcagggagagtgtgaggacagattaaagcagttacaataacaaaaaaaaaaaaaaaaaaaaaa

SEQ ID NO: 3 - DNA, 2763 bp, Mus musculus
  source 1..2763: mol_type = genomic DNA
gctccatcacacagtccatggaaagactgatcttttaaattgggggtagtggaggtggtggtctgtgcttgttaggaggggtctgggggctaagagggagctttgaaagggaagttctggcccttggtcagtcaagggtggggctcacatagtttctgtttcctcagttggcagttcagctggggccctccttcatgaatgttccgggaagcagtggctgcgtgcgcagggtaggctggccaggctgcagatgccagagcagattgcataaaaggttaggggacagtgggaaaggggtgtagccagatccagcatttgggtttcagtttggacaggaggtcaaataggcacccagagtgacctggagagggctttgggccactggactctctggtgctttccatgacaatggagagcccccagctctgcctcgtcctcttggtcttaggcttctcctctggaggtgtgagcgcaactccagtgcttgaggcccggccccaagtctcctgctctctggagggagtagagatcaaaggcggctcctttcaacttctccaaggcggtcaggccctggagtacctatgtccctctggcttctacccataccccgtgcagactcgaacctgcagatccacaggctcctggagcgacctgcagacccgagaccaaaagattgtccagaaggcggaatgcagagcaatacgctgcccacgaccgcaggactttgaaaatggggaattctggccccggtcccccttctacaacctgagtgaccagatttcttttcaatgctatgatggttacgttctccggggctctgctaatcgcacctgccaagagaatggccggtgggatgggcaaacagcaatttgtgatgatggagctggatactgtcccaatcccggtattcctattgggacaaggaaggtgggtagccaataccgccttgaagacattgttacttaccactgcagccggggacttgtcctgcgtggctcccagaagcgaaagtgtcaagaaggtggctcatggagtgggacagagccttcctgccaagattccttcatgtatgacagccctcaagaagtggccgaagcattcctatcctccctgacagagaccatcgaaggagccgatgctgaggatgggcacagcccaggagaacagcagaagaggaagattgtcctagacccctcgggctccatgaatatctacctggtgctagatggatcagacagcatcggaagcagcaacttcacaggggctaagcggtgcctcaccaacttgattgagaaggtggcgagttacggggtgaggccacgatatggtctcctgacatatgctacagtccccaaagtgttggtcagagtgtctgatgagaggagtagcgatgccgactgggtcacagagaagctcaaccaaatcagttatgaagaccacaagctgaagtcagggaccaacaccaagagggctctccaggctgtgtatagcatgatgagctgggcaggggatgccccgcctgaaggctggaatagaacccgccatgtcatcatcattatgactgatggcttgcacaacatgggtggaaaccctgtcactgtcattcaggacatccgagccttgctggacatcggcagggatcccaaaaatcccagggaggattacctggatgtgtatgtgtttggggtcgggcctctggtggactccgtgaacatcaatgccttagcttccaaaaaggacaatgagcatcatgtgtttaaagtcaaggatatggaagacctggagaatgttttctaccaaatgattgatgaaaccaaatctctgagtctctgtggcatggtgtgggagcataaaaaaggcaacgattatcataagcaaccatggcaagccaagatctcagtcactcgccctctgaaaggacatgagacctgtatgggggccgtggtgtctgagtacttcgtgctgacagcagcgcactgcttcatggtggatgatcagaaacattccatcaaggtcagcgtggggggtcagaggcgggacctggagattgaagaggtcctgttccaccccaaatacaatattaatgggaaaaaggcagaagggatccctgagttctatgattatgatgtggccctagtcaagctcaagaacaagctcaagtatggccagactctcaggcccatctgtctcccctgcacggagggaaccacacgagccttgaggcttcctcagacagccacctgcaagcagcacaaggaacagttgctccctgtgaaggatgtcaaagctctgtttgtatctgagcaagggaagagcctgactcggaaggaggtgtacatcaagaatggggacaagccagttgtgagagagatgctacaaaggcccaaggctatgagaaggtcaaagatgcctctgaggtggtcactccacggttcctctgcacaggaggggtggatccctatgctgaccccaacacatgcaaaggagattccgggggccctctcattgttcacaagagaagccgcttcattcaagttggtgtgattagctggggagtagtagatgtctgcagagaccagaggcggcaacagctggtaccctcttatgcccgggacttccacatcaacctcttccaggtgctgccctggctaaaggacaagctcaaagatgaggatttgggttttctataaagagcttcctgcagggagagtgtgaggacagattaaagcagttacaataacaaaaaaaaaaaaaaaaaaaaaa

SEQ ID NO: 4 - DNA, 2573 bp, Rattus norvegicus
  source 1..2573: mol_type = genomic DNA
cagcaggggccctccttcatgaatgttccgggaagcagcgtctgtgcagggtaggttggccaggctgcaggtgccagagcagattgcataaaaggttaggggccggtgggaaaggggtgtagccagatccagcactggagtttcagtctggacagcaagtcaagtagccacccagagtgaactggaaagggcttttggccacgggctttccatgacaatggagggtccccagctctgcttagtcctcttggtcttaggcctctcctccggaggtgtgagcgcaactccagtgcttgaggcccggccccaggtctcttgctctctggagggagtagagatcaaaggcggctccttccaacttctccaagacggtcaggccctggagtacctgtgtccctctggcttctacccataccctgtgcagactcgaacctgcaaatccacaggctcctggagtgtcctccagacccgggaccaaaagattgtcaagaaggcagaatgcagagcaatacgctgcccacgaccacaggactttgaaaatggggagttctggccccggtccccctactacaacctgagtgatcagatttcttttcaatgctatgatggctacactctccggggctctgctaatcgcacctgccaagagaatggccggtgggatgggcaaacagcaatctgtgatgatggagcgggatactgtcccaacccgggtattcctattgggacaaggaaggtgggaagccagtaccgtcttgaagacactgtcacttaccactgtagtcggggacttgtcctacgtggctcccagcagcgaaggtgccaggaaggtggctcgtggagtgggacagagccttcctgccaagattccttcatgtacgacagccctcaagaggtggccgaagcatttctatcctccctgacagagaccatcgaaggagcagatgcggaggatgggcacagcccaggggaacagcagaagaggaagattatcctggacccctcgggctccatgaatatctacatggtgctggatggatccgacagcatcggggccagcaacttcacaggggccaagcggtgtctcgccaacttgattgagaaggtggcgagttatggggtgaagccaagatacggtctagtgacatatgccacagtccccaaagtcttggtcagagtgtctgaggagaggagtagtgatgccgactgggtcacagagaagctcaaccaaatcagttatgaagaccacaagctgaagtcagggaccaacaccaagaaggctctccaggctgtatacagcatgatgagctggccaggggatgctccgcctgaaggctggaatcgaacccgccacgtcatcatcatcatgactgatggcttgcacaacatgggtggagaccctgtcactgtcattgaggacatccgagacttgctggatattggcagggatcgcaaaaatccccgggaggattatttggatgtgtatgtgtttggggtcgggcctctggtggaccctgtgaacatcaatgccttggcttccaaaaagaacaatgagcagcatgtgttcaaggtcaaggacatggaggatctggagaacgtcttctacaaaatgatcgatgaaaccaaatctctgggtctctgtggcatggtgtgggagcatcagaaaggcggtgattattacaagcaaccatggcaagccaagatctcagtcactcgtcctctgaaaggacatgagaactgtatgggggccgtggtgtccgagtacttcgtgctgacagcagcgcattgcttcacagtggaagatcagaaacactccatcaaggtcaacgtggaggggaaaaggcgggacctggagattgaagaggtcctgttccaccctaattacgacatcaatgggaaaaaggcagaaggaatctctgagttctatgactatgatgttgccctcatcaagctcaagaccaagctgaagtacagccagactctcaggcccatctgtctcccctgcacagagggaaccacccgagccttgcggcttcctcagacagccacctgcaaacagcacaaggaagagttgctccctatgaaggacgtcaaagctctgtttgtatccgaggaagggaagaagctgacccggaaggaggtgtacatcaagaatggggaaaagaaagccagttgtgagagagatgctacaaaggcccaaggctatgagaaggtcaaagttgcctctgaggtggtcacccccaggttcctgtgcaccggaggggtagatccctatgctgaccccaacacatgcaaaggagactccgggggccctctcattgttcacaagagaagccgcttcattcaagttggtgtgatcagctggggagtagtggatgtctgcaaagacccgaggcggcaacagttggtgccctcctatgcccgggacttccacatcaatctcttccaggtgctgccctggctaaaggagaagctcaaagacgaggacttgggtttcttataaggagcttcctgctgggagggtgagggcagattaaagcagctacaatacaaatacaaaaaaaaaaaaaaaa

SEQ ID NO: 5 - DNA, 2334 bp, Pan troglodytes
  source 1..2334: mol_type = genomic DNA
cccaggcccagcttctctcctgccttccaacgccatggggagcaatctcagcccccaactctgcctgatgcccttcatcttgggcctcttgtctggaggtgtgaccaccactccatggcctttggcccagccccaggaatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagtccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcttgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacacaccccaaaatttgggtcaaagtgtctgatccagacagcagtaatgcagactgggtcacgaagcagctcaatgaaatcaattatgaagaccacaagttgaagtcagggactaacaccaagaaggccctccaggcagtgtacagcatgatgagctggccagatgacatccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgattgatgaaagccagtctctgagtctctgtggcatggtttgggaacacaggaagggtaccgattaccacaagcaaccatggcaagccaagatctcagtcattcgcccttcaaagggacacgagagctgtatgggggctgtggtgtctgagtactttgtgctgacagcagcacactgtttcactgtggatgacaaggaacactcaatcaaggtcagcgtaggaggggagaagcgggacctggagatagaagtagtcctatttcaccccaactacaacattaatgggaaaaaagcagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaaaagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggt

SEQ ID NO: 6 - DNA, 2289 bp, Macaca fascicularis
  source 1..2289: mol_type = genomic DNA
atggggagcagtctcagcccccagctctacctgatgcccttcatcttgggcctcttatctgcaggtgtgaccaccactccattgtcttcggcccagcctcaaggatcctgctctctggagggggtagagatcaaaggtggctccttccgacttctccaagagggccaggcactggaatacgtgtgtccttctggcttctacccgtaccctgtgcagacacgtacctgcagatccacggggtcctggagcaccctgcagactcaagatcgaaaaactgtcaagaaggcagagtgcagagcaatccgctgtccacgaccacaggacttcgagaacggggaataccggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccaggcatccccattggcacaaggaaggtgggcagccggtaccgccttgaagacagcgtcacctaccactgcagccgggggcttaccctgcgtggctcccagcggcgaacatgtcaggaaggtggctcttggagcgggacggagccttcctgccaagactccttcatgtacgacacccctcaagaggtggccgaagctttcctgtcttccctgacggagaccatagaaggagtcgatgccgaggatgggcacagcccaggggaacaacagaagcggaggatcatcctagacccttcaggctccatgaacatctacctggtgctagatggatcagacagcattggggccggcaacttcacaggagccaaaaagtgtctagtcaacttaattgagaaggtggcaagttatggtgtgaagccaagatatgctctagtgacatatgccacataccccagaatttgggtcaaagtgtctgaccaagagagcagcaatgcagactgggtcacgaagaagctcagtgaaatcaattatgaagaccacaagttgaagtcagggactaacaccaagagggccctccaggcagtgtacagcatgatgagttggccagaggacatccctcctgaaggctggaaccgcacccgccatgtcatcatcctcatgaccgatggattgcacaacatgggcggggacccaattactgtcattgatgagatccgggacttgttatacatcggcaaggatcgtaaaaacccgagggaggattatctggatgtctatgtgtttggggttggacctttggtggaccaagtgaacatcaatgctttggcttccaagaaagacaatgagcaacatgtgttcaaagtcaaggatatggaaaacctggaagacgttttcttccaaatgattgatgaaagccagtctctgagtctctgtggcatggtttgggaacacacgacgggtaccgattaccacaagcaaccatggcaggccaagatctcagtcactcgcccttcgaagggacatgagagctgtatgggggctgtggtgtctgagtactttgtgctgacagcagcacattgttttactgtggacgacaaggaacactcgatcaaggtcagcgtggggaagaagcgggacctggagatagaaaaagtcctatttcaccccgactacaacattagcgggaaaaaagaagcaggaattcctgaattttatgactatgacgttgccctgatcaagctcaagaataagttgaattatgacccgactatcaggcccatttgtctcccctgcaccgagggaacaactcgagctttgaggcttcctccaactaccacttgccagcaacagaaggaagagctgctccctgcacaggatatcaaagctctgtttgtgtctgaggaggagaagaagctgactcggaaggaggtctacatcaagaatggggataagaaaggcagctgtgagagagatgctcaatatgccccaggctatgacaaagtcaaggacatctccgaggtggtcacccctcggttcctttgtactggaggagtgagtccctatgctgaccccaatacttgcagaggtgattctggcggccccttgatagttcacaagagaagtcgttttattcaagttggtgtcatcagctggggagtagtggatgtctgcaaaaaccagaagcggcaaaagcaggtacctgctcacgcccgagactttcacgtcaacctcttccaagtgctgccctggctgaaggagaaactccaagatgaggatttgggttttctc

SEQ ID NO: 7 - DNA, 2727 bp, Macaca fascicularis
  source 1..2727: mol_type = genomic DNA
atttctggtccctaagtgggtggtctgggcttgttggggaggagctgaggccagaaggaggtactgaaggggagagtcctggaccttgggcagcaaagggtgggacttctgcagtttctgcttccttgactggcagctcagcggggccctcccgcttggatgttccgggaaagtgatgagggtaggacaggcggggcaagctgcaggtgccagaacacagattgcataaaaggccgggagctggtggggggcaggggaagggaatgtgaccaggtctaggtctggagtttcagcttggacactgagctaagtagacaagcaaaacaagccaggacacgccatcctgccccaggcccagcttctctcctgccttctaacgccatggggagcagtctcagcccccagctctacctgatgcccttcatcttgggcctcttatctgcaggtgtgaccaccactccattgtcttcggcccagcctcaaggatcctgctctctggagggggtagagatcaaaggtggctccttccgacttctccaagagggccaggcactggaatacgtgtgtccttctggcttctacccgtaccctgtgcagacacgtacctgcagatccacggggtcctggagcaccctgcagactcaagatcgaaaaactgtcaagaaggcagagtgcagagcaatccgctgtccacgaccacaggacttcgagaacggggaataccggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccaggcatccccattggcacaaggaaggtgggcagccggtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacggagaccatagaaggagtcgatgccgaggatgggcacagcccaggggaacaacagaagcggaggatcatcctagacccttcaggctccatgaacatctacctggtgctagatggatcagacagcattggggccggcaacttcacaggagccaaaaagtgtctagtcaacttaattgagaaggtggcaagttatggtgtgaagccaagatatgctctagtgacatatgccacataccccagaatttgggtcaaagtgtctgaccaagagagcagcaatgcagactgggtcacgaagaagctcagtgaaatcaattatgaagaccacaagttgaagtcagggactaacaccaagagggccctccaggcagtgtacagcatgatgagttggccagaggacatccctcctgaaggctggaaccgcacccgccatgtcatcatcctcatgaccgatggattgcacaacatgggcggggacccaattactgtcattgatgagatccgggacttgttatacatcggcaaggatcgcaaaaacccgagggaggattatctggatgtctatgtgtttggggttggacctttggtggaccaagtgaacatcaatgctttggcttccaagaaagacaatgagcaacatgtgttcaaagtcaaggatatggaaaacctggaagacgttttcttccaaatgattgatgaaagccagtctctgagtctctgtggcatggtttgggaacacacgacgggtaccgattaccacaagcaaccatggcaggccaagatctcagtcactcgcccttcgaagggacatgagagctgtatgggggctgtggtgtctgagtactttgtgctgacagcagcacattgttttactgtggacgacaaggaacactcgatcaaggtcagcgtggggaagaagcgggacctggagatagaaaaagtcctatttcaccccgactacaacattagcgggaaaaaagaagcaggaattcctgaattttatgactatgacgttgccctgatcaagctcaagaaaaagttgaattatgacccgactatcaggcccatttgtctcccctgtaccgagggaacaactcgagctttgaggcttcctccaactaccacttgccagcaacagaaggaagagctgctccctgcacaggatatcaaagctctgtttgtgtctgaggaggagaagaagctgactcggaaggaggtctacatcaagaatggggataagaaaggcagctgtgagagagatgctcaatatgccccaggctatgacaaagtcaaggacatctcggaggtggtcacccctcggttcctttgtactggaggagtgagtccctatgctgaccccaatacttgcagaggtgattctggcggccccttgatagttcacaagagaagtcgtttcattcaagttggtgtcatcagctggggagtagtggatgtctgcaaaaaccagaagcggcaaaagcaggtacctgctcacgcccgagactttcacgtcaacctcttccaagtgctgccctggctgaaggagaaactccaagatgaggatttgggttttctctaaggggtttcctgctggacaggggcgcgggattgaattaaaacagctgcgacaaca

SEQ ID NO: 8 - DNA, 2476 bp, Homo sapiens
  source 1..2476: mol_type = genomic DNA
tgttgtcgcagctgttttaattcaatcccacgcccctgtccagcaggaaaccccttatagaaaacccaaatcctcatcttggagtttctccttcagccagggcagcacttgaaagaggttgatgtgaaagtctcgggcgtgagcaggtacctgcttttgccgcttctggtttttgcagacatccactactccccagctgattacaccaacttgaatgaaacgacttctcttgtgaactatcaaggggccgccagaatcacctctgcaagtattggggtcagcatagggactcactcctccagtacaaaggaaccgaggggtgaccacctctgagatgtccttgactttgtcatagcctggggcatattgagcatctctctcacagctgcctttcttatccccattcttgatgtagacctccttccgagtcagctttttctcctcctcagacacaaacagagctttgatatcctgtgcagggagcagctcttccttttgttgctggcaagtggtagttggaggaagcctcaaagctcgagttgttccctcggtgcaggggagacaaatgggcctgatagtctggccatatttcagcttattcttgagcttgatcagggcaacgtcatagtcataaaattcaggaattcctgcttcttttttcccattaatgttgtagttggggtgaaataggactacttctatctccaggtcccgcttctcccctcctacgctgaccttgattgagtgttccttgtcatccacagtgaaacaatgtgctgctgtcagcacaaagtactcagacaccacagcccccatacagctctcgtgtccctttgaagggcgaatgactgagatcttggcctgccatggttgcttgtggtaatcggtacccttcctgtgttcccaaaccatgccacagagactcagagactggctttcatcgatcatttggtagaaaacatcttccaggttttccatatccttgactttgaacacatgttgctcattgtctttcttggaagccaaagcattgatgttcacttggttcaccaaaggcccgaccccaaacacatagacatccagataatcctcccttgggtttttgcgatccttgccaatgtatagcaagtcccggatctcatcaatgacagtaattgggtccccgcccatgttgtgcaatccatcagtcatgaggatgatgacatggcgggtgcggttccagccttcaggagggacgtcatctggccagctcatcatgctgtacactgcctggagggccttcttggtgttagtccctgacttcaacttgtggtcttcataattgatttcattgagctgcttcgtgacccagtctgcattactgctgtctgcttcagacactttgacccaaattttggggtatgtggcatatgtcactagaccatatcttggcttcacaccataacttgccaccttctcaattaagttgactagacactttttggctcctgtgaagttgctggccccaatgctgtctgatccatctagcaccaggtagatgttcatggagcctgaagggtccaggacgatcttccgcttctgttgttcccctgggccgtgcccatcctcagcatcgactccttctatggtctctgtcagggaagacaggaaagcttcggccacctcttgaggggtgtcgtacatgaaggagtcttggcaggaaggctccgtcccgctccaagagccaccttcctgacacgttcgccgctgggagccacgcagggtaagcccccggctgcagtggtaggtgacgctgtcttcaaggcggtactggctgcccaccttccttgtgccaatggggatgcccgggttggagcagtaccccgctccgttgtcacagatcgctgtctgcccactccatcggccattcacttggcaggtgcgattggcagagccccggagagtgtaaccgtcatagcagtggaaagagatctcatcactcacattgtagtagggagaccggggccagtattccccgttctcgaagtcgtgtggtcttggacagtggattgctctgcactctgccttcctgacagtcttttggtcttgagtcttcagggtgctccaggaccccgtagatctgcaggtacgtgtctgcacagggtacgggtagaagccagaaggacacacgtactccagtgcctggccctcttggagaagtcggaaggagccgcctttgatctctaccccctccagagagcaggatccctggggccgggccaaagaccatggagtggtggtcacacctccagacaagaggcccaagataaagggcatcaggcagagttgggggctgagattgctccccatggcgttggaaggcaggagagaagctgggcctggggcaggatggtgtgtcctggcttgctttgcttgtctgcttggctcagtgtccaagctgaaactccagacctagacctggtcacattcccttccc

SEQ ID NO: 9 - DNA, 2767 bp, Mus musculus
  source 1..2767: mol_type = genomic DNA
ttttttttttttttttttttttgttattgtaactgctttaatctgtcctcacactctccctgcaggaagctctttatagaaaacccaaatcctcatctttgagcttgtcctttagccagggcagcacctggaagaggttgatgtggaagtcccgggcataagagggtaccagctgttgccgcctctggtctctgcagacatctactactccccagctaatcacaccaacttgaatgaagcggcttctcttgtgaacaatgagagggcccccggaatctcctttgcatgtgttggggtcagcatagggatccacccctcctgtgcagaggaaccgtggagtgaccacctcagaggcatctttgaccttctcatagccttgggcctttgtagcatctctctcacaactggctttcttgtccccattcttgatgtacacctccttccgagtcaggctcttcccttgctcagatacaaacagagctttgacatccttcacagggagcaactgttccttgtgctgcttgcaggtggctgtctgaggaagcctcaaggctcgtgtggttccctccgtgcaggggagacagatgggcctgagagtctggccatacttgagcttgttcttgagcttgactagggccacatcataatcatagaactcagggatcccttctgcctttttcccattaatattgtatttggggtggaacaggacctcttcaatctccaggtcccgcctctgaccccccacgctgaccttgatggaatgtttctgatcatccaccatgaagcagtgcgctgctgtcagcacgaagtactcagacaccacggcccccatacaggtctcatgtcctttcagagggcgagtgactgagatcttggcttgccatggttgcttatgataatcgttgccttttttatgctcccacaccatgccacagagactcagagatttggtttcatcaatcatttggtagaaaacattctccaggtcttccatatccttgactttaaacacatgatgctcattgtcctttttggaagctaaggcattgatgttcacggagtccaccagaggcccgaccccaaacacatacacatccaggtaatcctccctgggatttttgggatccctgccgatgtccagcaaggctcggatgtcctgaatgacagtgacagggtttccacccatgttgtgcaagccatcagtcataatgatgatgacatggcgggttctattccagccttcaggcggggcatcccctgcccagctcatcatgctatacacagcctggagagccctcttggtgttggtccctgacttcagcttgtggtcttcataactgatttggttgagcttctctgtgacccagtcggcatcgctactcctctcatcagacactctgaccaacactttggggactgtagcatatgtcaggagaccatatcgtggcctcaccccgtaactcgccaccttctcaatcaagttggtgaggcaccgcttagcccctgtgaagttgctgcttccgatgctgtctgatccatctagcaccaggtagatattcatggagcccgaggggtctaggacaatcttcctcttctgctgttctcctgggctgtgcccatcctcagcatcggctccttcgatggtctctgtcagggaggataggaatgcttcggccacttcttgagggctgtcatacatgaaggaatcttggcaggaaggctctgtcccactccatgagccaccttcttgacactttcgcttctgggagccacgcaggacaagtccccggctgcagtggtaagtaacaatgtcttcaaggcggtattggctacccaccttccttgtcccaataggaataccgggattgggacagtatccagctccatcatcacaaattgctgtttgcccatcccaccggccattctcttggcaggtgcgattagcagagccccggagaacgtaaccatcatagcattgaaaagaaatctggtcactcaggttgtagaagggggaccggggccagaattccccattttcaaagtcctgcggtcgtgggcagcgtattgctctgcattccgccttctggacaatcttttggtctcgggtctgcaggtcgctccaggagcctgtggatctgcaggttcgagtctgcacggggtatgggtagaagccagagggacataggtactccagggcctgaccgccttggagaagttgaaaggagccgcctttgatctctactccctccagagagcaggagacttggggccgggcctcaagcactggagttgcgctcacacctccagaggagaagcctaagaccaagaggacgaggcagagctgggggctctccattgtcatggaaagcaccagagagtccagtggcccaaagccctctccaggtcactctgggtgcctatttgacctcctgtccaaactgaaacccaaatgctggatctggctacacccctttcccactgtcccctaaccttttatgcaatctgctctggcatctgcagcctggccagcctaccctgcgcacgcagccactgcttcccggaacattcatgaaggagggccccagctgaactgccaactgaggaaacagaaactatgtgagccccacccttgactgaccaagggccagaacttccctttcaaagctccctcttagcccccagacccctcctaacaagcacagaccaccacctccactacccccaatttaaaagatcagtctttccatggactgtgtgatggagc

SEQ ID NO: 10 - DNA, 2763 bp, Mus musculus
  source 1..2763: mol_type = genomic DNA
ttttttttttttttttttttttgttattgtaactgctttaatctgtcctcacactctccctgcaggaagctctttatagaaaacccaaatcctcatctttgagcttgtcctttagccagggcagcacctggaagaggttgatgtggaagtcccgggcataagagggtaccagctgttgccgcctctggtctctgcagacatctactactccccagctaatcacaccaacttgaatgaagcggcttctcttgtgaacaatgagagggcccccggaatctcctttgcatgtgttggggtcagcatagggatccacccctcctgtgcagaggaaccgtggagtgaccacctcagaggcatctttgaccttctcatagccttgggcctttgtagcatctctctcacaactggcttgtccccattcttgatgtacacctccttccgagtcaggctcttcccttgctcagatacaaacagagctttgacatccttcacagggagcaactgttccttgtgctgcttgcaggtggctgtctgaggaagcctcaaggctcgtgtggttccctccgtgcaggggagacagatgggcctgagagtctggccatacttgagcttgttcttgagcttgactagggccacatcataatcatagaactcagggatcccttctgcctttttcccattaatattgtatttggggtggaacaggacctcttcaatctccaggtcccgcctctgaccccccacgctgaccttgatggaatgtttctgatcatccaccatgaagcagtgcgctgctgtcagcacgaagtactcagacaccacggcccccatacaggtctcatgtcctttcagagggcgagtgactgagatcttggcttgccatggttgcttatgataatcgttgccttttttatgctcccacaccatgccacagagactcagagatttggtttcatcaatcatttggtagaaaacattctccaggtcttccatatccttgactttaaacacatgatgctcattgtcctttttggaagctaaggcattgatgttcacggagtccaccagaggcccgaccccaaacacatacacatccaggtaatcctccctgggatttttgggatccctgccgatgtccagcaaggctcggatgtcctgaatgacagtgacagggtttccacccatgttgtgcaagccatcagtcataatgatgatgacatggcgggttctattccagccttcaggcggggcatcccctgcccagctcatcatgctatacacagcctggagagccctcttggtgttggtccctgacttcagcttgtggtcttcataactgatttggttgagcttctctgtgacccagtcggcatcgctactcctctcatcagacactctgaccaacactttggggactgtagcatatgtcaggagaccatatcgtggcctcaccccgtaactcgccaccttctcaatcaagttggtgaggcaccgcttagcccctgtgaagttgctgcttccgatgctgtctgatccatctagcaccaggtagatattcatggagcccgaggggtctaggacaatcttcctcttctgctgttctcctgggctgtgcccatcctcagcatcggctccttcgatggtctctgtcagggaggataggaatgcttcggccacttcttgagggctgtcatacatgaaggaatcttggcaggaaggctctgtcccactccatgagccaccttcttgacactttcgcttctgggagccacgcaggacaagtccccggctgcagtggtaagtaacaatgtcttcaaggcggtattggctacccaccttccttgtcccaataggaataccgggattgggacagtatccagctccatcatcacaaattgctgtttgcccatcccaccggccattctcttggcaggtgcgattagcagagccccggagaacgtaaccatcatagcattgaaaagaaatctggtcactcaggttgtagaagggggaccggggccagaattccccattttcaaagtcctgcggtcgtgggcagcgtattgctctgcattccgccttctggacaatcttttggtctcgggtctgcaggtcgctccaggagcctgtggatctgcaggttcgagtctgcacggggtatgggtagaagccagagggacataggtactccagggcctgaccgccttggagaagttgaaaggagccgcctttgatctctactccctccagagagcaggagacttggggccgggcctcaagcactggagttgcgctcacacctccagaggagaagcctaagaccaagaggacgaggcagagctgggggctctccattgtcatggaaagcaccagagagtccagtggcccaaagccctctccaggtcactctgggtgcctatttgacctcctgtccaaactgaaacccaaatgctggatctggctacacccctttcccactgtcccctaaccttttatgcaatctgctctggcatctgcagcctggccagcctaccctgcgcacgcagccactgcttcccggaacattcatgaaggagggccccagctgaactgccaactgaggaaacagaaactatgtgagccccacccttgactgaccaagggccagaacttccctttcaaagctccctcttagcccccagacccctcctaacaagcacagaccaccacctccactacccccaatttaaaagatcagtctttccatggactgtgtgatggagc

SEQ ID NO: 11 - DNA, 2573 bp, Rattus norvegicus
  source 1..2573: mol_type = genomic DNA
ttttttttttttttttgtatttgtattgtagctgctttaatctgccctcaccctcccagcaggaagctccttataagaaacccaagtcctcgtctttgagcttctcctttagccagggcagcacctggaagagattgatgtggaagtcccgggcataggagggcaccaactgttgccgcctcgggtctttgcagacatccactactccccagctgatcacaccaacttgaatgaagcggcttctcttgtgaacaatgagagggcccccggagtctcctttgcatgtgttggggtcagcatagggatctacccctccggtgcacaggaacctgggggtgaccacctcagaggcaactttgaccttctcatagccttgggcctttgtagcatctctctcacaactggctttcttttccccattcttgatgtacacctccttccgggtcagcttcttcccttcctcggatacaaacagagctttgacgtccttcatagggagcaactcttccttgtgctgtttgcaggtggctgtctgaggaagccgcaaggctcgggtggttccctctgtgcaggggagacagatgggcctgagagtctggctgtacttcagcttggtcttgagcttgatgagggcaacatcatagtcatagaactcagagattccttctgcctttttcccattgatgtcgtaattagggtggaacaggacctcttcaatctccaggtcccgccttttcccctccacgttgaccttgatggagtgtttctgatcttccactgtgaagcaatgcgctgctgtcagcacgaagtactcggacaccacggcccccatacagttctcatgtcctttcagaggacgagtgactgagatcttggcttgccatggttgcttgtaataatcaccgcctttctgatgctcccacaccatgccacagagacccagagatttggtttcatcgatcattttgtagaagacgttctccagatcctccatgtccttgaccttgaacacatgctgctcattgttctttttggaagccaaggcattgatgttcacagggtccaccagaggcccgaccccaaacacatacacatccaaataatcctcccggggatttttgcgatccctgccaatatccagcaagtctcggatgtcctcaatgacagtgacagggtctccacccatgttgtgcaagccatcagtcatgatgatgatgacgtggcgggttcgattccagccttcaggcggagcatcccctggccagctcatcatgctgtatacagcctggagagccttcttggtgttggtccctgacttcagcttgtggtcttcataactgatttggttgagcttctctgtgacccagtcggcatcactactcctctcctcagacactctgaccaagactttggggactgtggcatatgtcactagaccgtatcttggcttcaccccataactcgccaccttctcaatcaagttggcgagacaccgcttggcccctgtgaagttgctggccccgatgctgtcggatccatccagcaccatgtagatattcatggagcccgaggggtccaggataatcttcctcttctgctgttcccctgggctgtgcccatcctccgcatctgctccttcgatggtctctgtcagggaggatagaaatgcttcggccacctcttgagggctgtcgtacatgaaggaatcttggcaggaaggctctgtcccactccacgagccaccttcctggcaccttcgctgctgggagccacgtaggacaagtccccgactacagtggtaagtgacagtgtcttcaagacggtactggcttcccaccttccttgtcccaataggaatacccgggttgggacagtatcccgctccatcatcacagattgctgtttgcccatcccaccggccattctcttggcaggtgcgattagcagagccccggagagtgtagccatcatagcattgaaaagaaatctgatcactcaggttgtagtagggggaccggggccagaactccccattttcaaagtcctgtggtcgtgggcagcgtattgctctgcattctgccttcttgacaatcttttggtcccgggtctggaggacactccaggagcctgtggatttgcaggttcgagtctgcacagggtatgggtagaagccagagggacacaggtactccagggcctgaccgtcttggagaagttggaaggagccgcctttgatctctactccctccagagagcaagagacctggggccgggcctcaagcactggagttgcgctcacacctccggaggagaggcctaagaccaagaggactaagcagagctggggaccctccattgtcatggaaagcccgtggccaaaagccctttccagttcactctgggtggctacttgacttgctgtccagactgaaactccagtgctggatctggctacacccctttcccaccggcccctaaccttttatgcaatctgctctggcacctgcagcctggccaacctaccctgcacagacgctgcttcccggaacattcatgaaggagggcccctgctg

SEQ ID NO: 12 - DNA, 2334 bp, Pan troglodytes
  source 1..2334: mol_type = genomic DNA
accccttatagaaaacccaaatcctcatcttggagtttctccttcagccagggcagcacttgaaagaggttgatgtgaaagtctcgggcgtgagcaggtacctgcttttgccgcttctggtttttgcagacatccactactccccagctgattacaccaacttgaatgaaacgacttcttttgtgaactatcaaggggccgccagaatcacctctgcaagtattggggtcagcatagggactcactcctccagtacaaaggaaccgaggggtgaccacctctgagatgtccttgactttgtcatagcctggggcatattgagcatctctctcacagctgcctttcttatccccattcttgatgtagacctccttccgagtcagctttttctcctcctcagacacaaacagagctttgatatcctgtgcagggagcagctcttccttttgttgctggcaagtggtagttggaggaagcctcaaagctcgagttgttccctcggtgcaggggagacaaatgggcctgatagtctggccatatttcagcttattcttgagcttgatcagggcaacgtcatagtcataaaattcaggaattcctgctgcttttttcccattaatgttgtagttggggtgaaataggactacttctatctccaggtcccgcttctcccctcctacgctgaccttgattgagtgttccttgtcatccacagtgaaacagtgtgctgctgtcagcacaaagtactcagacaccacagcccccatacagctctcgtgtccctttgaagggcgaatgactgagatcttggcttgccatggttgcttgtggtaatcggtacccttcctgtgttcccaaaccatgccacagagactcagagactggctttcatcaatcatttggtagaaaacatcttccaggttttccatatccttgactttgaacacatgttgctcattgtctttcttggaagccaaagcattgatgttcacttggttcaccaaaggcccgaccccaaacacatagacatccagataatcctcccttgggtttttgcgatccttgccaatgtatagcaagtcccggatctcatcaatgacagtaattgggtccccgcccatgttgtgcaatccatcagtcatgaggatgatgacatggcgggtgcggttccagccttcaggagggatgtcatctggccagctcatcatgctgtacactgcctggagggccttcttggtgttagtccctgacttcaacttgtggtcttcataattgatttcattgagctgcttcgtgacccagtctgcattactgctgtctggatcagacactttgacccaaattttggggtgtgtggcatatgtcactagaccatatcttggcttcacaccataacttgccaccttctcaattaagttgactagacactttttggctcctgtgaagttgctggccccaatgctgtctgatccatctagcaccaggtagatgttcatggagcctgaagggtccaggacgatcttccgcttctgttgttcccctgggccgtgcccatcctcagcatcgactccttctatggtctctgtcagggaagacaggaaagcttcggccacctcttgaggggtgtcgtacatgaaggagtcttggcaagaaggctccgtcccgctccaagagccaccttcctgacacgttcgccgctgggagccacgcagggtaagcccccggctgcagtggtaggtgacgctgtcttcaaggcggtactggctgcccaccttccttgtgccaatggggatgcccgggttggagcagtaccccgctccgttgtcacagatcgctgtctgcccactccaccggccattcacttggcaggtgcgattggcagagccccggagagtgtaaccgtcatagcagtggaaagagatctcatcactcacattgtagtagggagaccggggccagtattccccgttctcgaagtcgtgtggtcttggacagtggattgctctgcactctgccttcctgacagtcttttggacttgagtcttcagggtgctccaggaccccgtagatctgcaggtacgtgtctgcacagggtacgggtagaagccagaaggacacacgtactccagtgcctggccctcttggagaagtcggaaggagccgcctttgatctctaccccctccagagagcaggattcctggggctgggccaaaggccatggagtggtggtcacacctccagacaagaggcccaagatgaagggcatcaggcagagttgggggctgagattgctccccatggcgttggaaggcaggagagaagctgggcctggg

SEQ ID NO: 13 - DNA, 2289 bp, Macaca fascicularis
  source 1..2289: mol_type = genomic DNA
gagaaaacccaaatcctcatcttggagtttctccttcagccagggcagcacttggaagaggttgacgtgaaagtctcgggcgtgagcaggtacctgcttttgccgcttctggtttttgcagacatccactactccccagctgatgacaccaacttgaataaaacgacttctcttgtgaactatcaaggggccgccagaatcacctctgcaagtattggggtcagcatagggactcactcctccagtacaaaggaaccgaggggtgaccacctcggagatgtccttgactttgtcatagcctggggcatattgagcatctctctcacagctgcctttcttatccccattcttgatgtagacctccttccgagtcagcttcttctcctcctcagacacaaacagagctttgatatcctgtgcagggagcagctcttccttctgttgctggcaagtggtagttggaggaagcctcaaagctcgagttgttccctcggtgcaggggagacaaatgggcctgatagtcgggtcataattcaacttattcttgagcttgatcagggcaacgtcatagtcataaaattcaggaattcctgcttcttttttcccgctaatgttgtagtcggggtgaaataggactttttctatctccaggtcccgcttcttccccacgctgaccttgatcgagtgttccttgtcgtccacagtaaaacaatgtgctgctgtcagcacaaagtactcagacaccacagcccccatacagctctcatgtcccttcgaagggcgagtgactgagatcttggcctgccatggttgcttgtggtaatcggtacccgtcgtgtgttcccaaaccatgccacagagactcagagactggctttcatcaatcatttggaagaaaacgtcttccaggttttccatatccttgactttgaacacatgttgctcattgtctttcttggaagccaaagcattgatgttcacttggtccaccaaaggtccaaccccaaacacatagacatccagataatcctccctcgggtttttacgatccttgccgatgtataacaagtcccggatctcatcaatgacagtaattgggtccccgcccatgttgtgcaatccatcggtcatgaggatgatgacatggcgggtgcggttccagccttcaggagggatgtcctctggccaactcatcatgctgtacactgcctggagggccctcttggtgttagtccctgacttcaacttgtggtcttcataattgatttcactgagcttcttcgtgacccagtctgcattgctgctctcttggtcagacactttgacccaaattctggggtatgtggcatatgtcactagagcatatcttggcttcacaccataacttgccaccttctcaattaagttgactagacactttttggctcctgtgaagttgccggccccaatgctgtctgatccatctagcaccaggtagatgttcatggagcctgaagggtctaggatgatcctccgcttctgttgttcccctgggctgtgcccatcctcggcatcgactccttctatggtctccgtcagggaagacaggaaagcttcggccacctcttgaggggtgtcgtacatgaaggagtcttggcaggaaggctccgtcccgctccaagagccaccttcctgacatgttcgccgctgggagccacgcagggtaagcccccggctgcagtggtaggtgacgctgtcttcaaggcggtaccggctgcccaccttccttgtgccaatggggatgcctgggttggagcagtaccccgctccgttgtcacagatcgctgtctgcccactccaccggccattcacttggcaggtgcgattggcagagccccggagagtgtaaccgtcatagcagtggaaagagatctcatcactcacattgtagtagggagaccggggccggtattccccgttctcgaagtcctgtggtcgtggacagcggattgctctgcactctgccttcttgacagtttttcgatcttgagtctgcagggtgctccaggaccccgtggatctgcaggtacgtgtctgcacagggtacgggtagaagccagaaggacacacgtattccagtgcctggccctcttggagaagtcggaaggagccacctttgatctctaccccctccagagagcaggatccttgaggctgggccgaagacaatggagtggtggtcacacctgcagataagaggcccaagatgaagggcatcaggtagagctgggggctgagactgctccccat

SEQ ID NO: 14 - DNA, 2727 bp, Macaca fascicularis
  source 1..2727: mol_type = genomic DNA
tgttgtcgcagctgttttaattcaatcccgcgcccctgtccagcaggaaaccccttagagaaaacccaaatcctcatcttggagtttctccttcagccagggcagcacttggaagaggttgacgtgaaagtctcgggcgtgagcaggtacctgcttttgccgcttctggtttttgcagacatccactactccccagctgatgacaccaacttgaatgaaacgacttctcttgtgaactatcaaggggccgccagaatcacctctgcaagtattggggtcagcatagggactcactcctccagtacaaaggaaccgaggggtgaccacctccgagatgtccttgactttgtcatagcctggggcatattgagcatctctctcacagctgcctttcttatccccattcttgatgtagacctccttccgagtcagcttcttctcctcctcagacacaaacagagctttgatatcctgtgcagggagcagctcttccttctgttgctggcaagtggtagttggaggaagcctcaaagctcgagttgttccctcggtacaggggagacaaatgggcctgatagtcgggtcataattcaactttttcttgagcttgatcagggcaacgtcatagtcataaaattcaggaattcctgcttcttttttcccgctaatgttgtagtcggggtgaaataggactttttctatctccaggtcccgcttcttccccacgctgaccttgatcgagtgttccttgtcgtccacagtaaaacaatgtgctgctgtcagcacaaagtactcagacaccacagcccccatacagctctcatgtcccttcgaagggcgagtgactgagatcttggcctgccatggttgcttgtggtaatcggtacccgtcgtgtgttcccaaaccatgccacagagactcagagactggctttcatcaatcatttggaagaaaacgtcttccaggttttccatatccttgactttgaacacatgttgctcattgtctttcttggaagccaaagcattgatgttcacttggtccaccaaaggtccaaccccaaacacatagacatccagataatcctccctcgggtttttgcgatccttgccgatgtataacaagtcccggatctcatcaatgacagtaattgggtccccgcccatgttgtgcaatccatcggtcatgaggatgatgacatggcgggtgcggttccagccttcaggagggatgtcctctggccaactcatcatgctgtacactgcctggagggccctcttggtgttagtccctgacttcaacttgtggtcttcataattgatttcactgagcttcttcgtgacccagtctgcattgctgctctcttggtcagacactttgacccaaattctggggtatgtggcatatgtcactagagcatatcttggcttcacaccataacttgccaccttctcaattaagttgactagacactttttggctcctgtgaagttgccggccccaatgctgtctgatccatctagcaccaggtagatgttcatggagcctgaagggtctaggatgatcctccgcttctgttgttcccctgggctgtgcccatcctcggcatcgactccttctatggtctccgtcagggaagacaggaaagcttcggccacctcttgaggggtgtcgtacatgaaggagtcttggcaggaaggctccgtcccgctccaagagccaccttcctgacacgttcgccgctgggagccacgcagggtaagcccccggctgcagtggtaggtgacgctgtcttcaaggcggtaccggctgcccaccttccttgtgccaatggggatgcctgggttggagcagtaccccgctccgttgtcacagatcgctgtctgcccactccaccggccattcacttggcaggtgcgattggcagagccccggagagtgtaaccgtcatagcagtggaaagagatctcatcactcacattgtagtagggagaccggggccggtattccccgttctcgaagtcctgtggtcgtggacagcggattgctctgcactctgccttcttgacagtttttcgatcttgagtctgcagggtgctccaggaccccgtggatctgcaggtacgtgtctgcacagggtacgggtagaagccagaaggacacacgtattccagtgcctggccctcttggagaagtcggaaggagccacctttgatctctaccccctccagagagcaggatccttgaggctgggccgaagacaatggagtggtggtcacacctgcagataagaggcccaagatgaagggcatcaggtagagctgggggctgagactgctccccatggcgttagaaggcaggagagaagctgggcctggggcaggatggcgtgtcctggcttgttttgcttgtctacttagctcagtgtccaagctgaaactccagacctagacctggtcacattcccttcccctgccccccaccagctcccggccttttatgcaatctgtgttctggcacctgcagcttgccccgcctgtcctaccctcatcactttcccggaacatccaagcgggagggccccgctgagctgccagtcaaggaagcagaaactgcagaagtcccaccctttgctgcccaaggtccaggactctccccttcagtacctccttctggcctcagctcctccccaacaagcccagaccacccacttagggaccagaaat

SEQ ID NO: 15 - protein, 16 aa, unidentified
AAVALLPAVLLALLAP

SEQ ID NO: 16 - protein, 11 aa, unidentified
AALLPVLLAAP

SEQ ID NO: 17 - protein, 13 aa, Human immunodeficiency virus
GRKKRRQRRRPPQ

SEQ ID NO: 18 - protein, 16 aa, Drosophila sp.
RQIKIWFQNRRMKWKK

SEQ ID NO: 19 - RNA, 21 nt, synthetic construct
  source 1..21: mol_type = other RNA
aagggaatgtgaccaggtctt

SEQ ID NO: 20 - RNA, 21 nt, synthetic construct
  source 1..21: mol_type = other RNA
agggaatgtgaccaggtctat

SEQ ID NO: 21 - RNA, 21 nt, synthetic construct
  source 1..21: mol_type = other RNA
gggaatgtgaccaggtctagt

SEQ ID NO: 22 - RNA, 21 nt, synthetic construct
  source 1..21: mol_type = other RNA
ggaatgtgaccaggtctaggt

SEQ ID NO: 23 - RNA, 21 nt, synthetic construct
  source 1..21: mol_type = other RNA
tgtgaccaggtctaggtctgt

SEQ ID NO: 24 - RNA, 21 nt, synthetic construct
  source 1..21: mol_type = other RNA
gtgaccaggtctaggtctggt

SEQ ID NO: 25 - RNA, 21 nt, synthetic construct
  source 1..21: mol_type = other RNA
aggtctaggtctggagtttct

SEQ ID NO: 26 - RNA, 21 nt, synthetic construct
  source 1..21: mol_type = other RNA
gtctggagtttcagcttggat

SEQ ID NO: 27 - RNA, 21 nt, synthetic construct
  source 1..21: mol_type = other RNA
tctggagtttcagcttggact

SEQ ID NO: 28 - RNA, 21 nt, synthetic construct
  source 1..21: mol_type = other RNA
ctggagtttcagcttggacat

SEQ ID NO: 29 - RNA, 21 nt, synthetic construct
  source 1..21: mol_type = other RNA
tccttccgacttctccaagat

SEQ ID NO: 30 - RNA, 21 nt, synthetic construct
  source 1..21: mol_type = other RNA
tgtccttctggcttctaccct

SEQ ID NO: 31 - RNA, 21 nt, synthetic construct
  source 1..21: mol_type = other RNA
tccttctggcttctacccgtt

SEQ ID NO: 32 - RNA, 21 nt, synthetic construct
  source 1..21: mol_type = other RNA
ccttctggcttctacccgtat

SEQ ID NO: 33 - RNA, 21 nt, synthetic construct
  source 1..21: mol_type = other RNA
cttctggcttctacccgtact

SEQ ID NO: 34 - RNA, 21 nt, synthetic construct
  source 1..21: mol_type = other RNA
ctggcttctacccgtaccctt

SEQ ID NO: 35 - RNA, 21 nt, synthetic construct
  source 1..21: mol_type = other RNA
ctacccgtaccctgtgcagat

SEQ ID NO: 36 - RNA, 21 nt, synthetic construct
  source 1..21: mol_type = other RNA
tgcagacacgtacctgcagat

SEQ ID NO: 37 - RNA, 21 nt, synthetic construct
  source 1..21: mol_type = other RNA
aaggcagagtgcagagcaatt

SEQ ID NO: 38 - RNA, 21 nt, synthetic construct
  source 1..21: mol_type = other RNA
ggcagagtgcagagcaatcct

SEQ ID NO: 39 - RNA, 21 nt, synthetic construct
  source 1..21: mol_type = other RNA
cggtctccctactacaatgtt

SEQ ID NO: 40 - RNA, 21 nt, synthetic construct
  source 1..21: mol_type = other RNA
ccctactacaatgtgagtgat

SEQ ID NO: 41 - RNA, 21 nt, synthetic construct
  source 1..21: mol_type = other RNA
cctactacaatgtgagtgatt

SEQ ID NO: 42 - RNA, 21 nt, synthetic construct
  source 1..21: mol_type = other RNA
ctactacaatgtgagtgatgt

SEQ ID NO: 43 - RNA, 21 nt, synthetic construct
  source 1..21: mol_type = other RNA
actacaatgtgagtgatgagt

SEQ ID NO: 44 - RNA, 21 nt, synthetic construct
  source 1..21: mol_type = other RNA
acaatgtgagtgatgagatct

SEQ ID NO: 45 - RNA, 21 nt, synthetic construct
  source 1..21: mol_type = other RNA
caatgtgagtgatgagatctt

SEQ ID NO: 46 - RNA, 21 nt, synthetic construct
  source 1..21: mol_type = other RNA
aatgtgagtgatgagatctct

SEQ ID NO: 47 - RNA, 21 nt, synthetic construct
  source 1..21: mol_type = other RNA
atgtgagtgatgagatctctt

SEQ ID NO: 48 - RNA, 21 nt, synthetic construct
  source 1..21: mol_type = other RNA
tgtgagtgatgagatctcttt

SEQ ID NO: 49 - RNA, 21 nt, synthetic construct
  source 1..21: mol_type = other RNA
gtgagtgatgagatctctttt

SEQ ID NO: 50 - RNA, 21 nt, synthetic construct
  source 1..21: mol_type = other RNA
tgagtgatgagatctctttct

SEQ ID NO: 51 - RNA, 21 nt, synthetic construct
  source 1..21: mol_type = other RNA
gagtgatgagatctctttcct

SEQ ID NO: 52 - RNA, 21 nt, synthetic construct
  source 1..21: mol_type = other RNA
agtgatgagatctctttccat

SEQ ID NO: 53 - RNA, 21 nt, synthetic construct
  source 1..21: mol_type = other RNA
gtgatgagatctctttccact

SEQ ID NO: 54 - RNA, 21 nt, synthetic construct
  source 1..21: mol_type = other RNA
tgatgagatctctttccactt

SEQ ID NO: 55 - RNA, 21 nt, synthetic construct
  source 1..21: mol_type = other RNA
gatctctttccactgctatgt

SEQ ID NO: 56 - RNA, 21 nt, synthetic construct
  source 1..21: mol_type = other RNA
atctctttccactgctatgat

SEQ ID NO: 57 - RNA, 21 nt, synthetic construct
  source 1..21: mol_type = other RNA
tctctttccactgctatgact

SEQ ID NO: 58 - RNA, 21 nt, synthetic construct
  source 1..21: mol_type = other RNA
ctctttccactgctatgacgt

SEQ ID NO: 59 - RNA, 21 nt, synthetic construct
  source 1..21: mol_type = other RNA
tctttccactgctatgacggt

SEQ ID NO: 60 - RNA, 21 nt, synthetic construct
  source 1..21: mol_type = other RNA
actgctatgacggttacactt

SEQ ID NO: 61 - RNA, 21 nt, synthetic construct
  source 1..21: mol_type = other RNA
ctgctatgacggttacactct

SEQ ID NO: 62 - RNA, 21 nt, synthetic construct
  source 1..21: mol_type = other RNA
tatgacggttacactctccgt

SEQ ID NO: 63 - RNA, 21 nt, synthetic construct
  source 1..21: mol_type = other RNA
atgacggttacactctccggt

SEQ ID NO: 64 - RNA, 21 nt, synthetic construct
  source 1..21: mol_type = other RNA
atcgcacctgccaagtgaatt

SEQ ID NO: 65 - RNA, 21 nt, synthetic construct
  source 1..21: mol_type = other RNA
tcgcacctgccaagtgaatgt

SEQ ID NO: 66 - RNA, 21 nt, synthetic construct
  source 1..21: mol_type = other RNA
cgcacctgccaagtgaatggt

SEQ ID NO: 67 - RNA, 21 nt, synthetic construct
  source 1..21: mol_type = other RNA
cagacagcgatctgtgacaat

SEQ ID NO: 68 - RNA, 21 nt, synthetic construct
  source 1..21: mol_type = other RNA
agacagcgatctgtgacaact

SEQ ID NO: 69 - RNA, 21 nt, synthetic construct
  source 1..21: mol_type = other RNA
gacagcgatctgtgacaacgt

SEQ ID NO: 70 - RNA, 21 nt, synthetic construct
  source 1..21: mol_type = other RNA
acagcgatctgtgacaacggt

SEQ ID NO: 71 - RNA, 21 nt, synthetic construct
  source 1..21: mol_type = other RNA
cagcgatctgtgacaacggat

SEQ ID NO: 72 - RNA, 21 nt, synthetic construct
  source 1..21: mol_type = other RNA
agcgatctgtgacaacggagt

SEQ ID NO: 73 - RNA, 21 nt, synthetic construct
  source 1..21: mol_type = other RNA
tggcacaaggaaggtgggcat

SEQ ID NO: 74 - RNA, 21 nt, synthetic construct
  source 1..21: mol_type = other RNA
ccgccttgaagacagcgtcat

SEQ ID NO: 75 - RNA, 21 nt, synthetic construct
  source 1..21: mol_type = other RNA
cttgaagacagcgtcacctat

SEQ ID NO: 76 - RNA, 21 nt, synthetic construct
  source 1..21: mol_type = other RNA
ttgaagacagcgtcacctact

SEQ ID NO: 77 - RNA, 21 nt, synthetic construct
  source 1..21: mol_type = other RNA
tgaagacagcgtcacctacct

SEQ ID NO: 78 - RNA, 21 nt, synthetic construct
  source 1..21: mol_type = other RNA
gtgtcaggaaggtggctcttt

SEQ ID NO: 79 - RNA, 21 nt, synthetic construct
  source 1..21: mol_type = other RNA
ccttcctgccaagactccttt

SEQ ID NO: 80 - RNA, 21 nt, synthetic construct
  source 1..21: mol_type = other RNA
tcctgccaagactccttcatt

SEQ ID NO: 81 - RNA, 21 nt, synthetic construct
  source 1..21: mol_type = other RNA
ctgccaagactccttcatgtt

SEQ ID NO: 82 - RNA, 21 nt, synthetic construct
  source 1..21: mol_type = other RNA
tgccaagactccttcatgtat

SEQ ID NO: 83 - RNA, 21 nt, synthetic construct
  source 1..21: mol_type = other RNA
caagactccttcatgtacgat

SEQ ID NO: 84 - RNA, 21 nt, synthetic construct
  source 1..21: mol_type = other RNA
aagactccttcatgtacgact

SEQ ID NO: 85 - RNA, 21 nt, synthetic construct
  source 1..21: mol_type = other RNA
agactccttcatgtacgacat

SEQ ID NO: 86 - RNA, 21 nt, synthetic construct
  source 1..21: mol_type = other RNA
gactccttcatgtacgacact

SEQ ID NO: 87 - RNA, 21 nt, synthetic construct
  source 1..21: mol_type = other RNA
caagaggtggccgaagctttt

SEQ ID NO: 88 - RNA, 21 nt, synthetic construct
  source 1..21: mol_type = other RNA
gccgaagctttcctgtcttct

SEQ ID NO: 89 - RNA, 21 nt, synthetic construct
  source 1..21: mol_type = other RNA
agagaccatagaaggagtcgt

SEQ ID NO: 90 - RNA, 21 nt, synthetic construct
  source 1..21: mol_type = other RNA
gagaccatagaaggagtcgat

SEQ ID NO: 91 - RNA, 21 nt, synthetic construct
  source 1..21: mol_type = other RNA
agaccatagaaggagtcgatt

SEQ ID NO: 92 - RNA, 21 nt, synthetic construct
  source 1..21: mol_type = other RNA
gaccatagaaggagtcgatgt

SEQ ID NO: 93 - RNA, 21 nt, synthetic construct
  source 1..21: mol_type = other RNA
accatagaaggagtcgatgct

SEQ ID NO: 94 - RNA, 21 nt, synthetic construct
  source 1..21: mol_type = other RNA
ccttcaggctccatgaacatt

SEQ ID NO: 95 - RNA, 21 nt, synthetic construct
  source 1..21: mol_type = other RNA
tcaggctccatgaacatctat

SEQ ID NO: 96 - RNA, 21 nt, synthetic construct
  source 1..21: mol_type = other RNA
caggctccatgaacatctact

SEQ ID NO: 97 - RNA, 21 nt, synthetic construct
  source 1..21: mol_type = other RNA
tgaacatctacctggtgctat

SEQ ID NO: 98 - RNA, 21 nt, synthetic construct
  source 1..21: mol_type = other RNA
aacatctacctggtgctagat

SEQ ID NO: 99 - RNA, 21 nt, synthetic construct
  source 1..21: mol_type = other RNA
catctacctggtgctagatgt

SEQ ID NO: 100 - RNA, 21 nt, synthetic construct
  source 1..21: mol_type = other RNA
atctacctggtgctagatggt

SEQ ID NO: 101 - RNA, 21 nt, synthetic construct
  source 1..21: mol_type = other RNA
tctacctggtgctagatggat

SEQ ID NO: 102 - RNA, 21 nt, synthetic construct
  source 1..21: mol_type = other RNA
ctacctggtgctagatggatt

SEQ ID NO: 103 - RNA, 21 nt, synthetic construct
  source 1..21: mol_type = other RNA
tacctggtgctagatggatct

SEQ ID NO: 104 - RNA, 21 nt, synthetic construct
  source 1..21: mol_type = other RNA
acctggtgctagatggatcat

SEQ ID NO: 105 - RNA, 21 nt, synthetic construct
  source 1..21: mol_type = other RNA
cctggtgctagatggatcagt

SEQ ID NO: 106 - RNA, 21 nt, synthetic construct
  source 1..21: mol_type = other RNA
tggtgctagatggatcagact

SEQ ID NO: 107 - RNA, 21 nt, synthetic construct
  source 1..21: mol_type = other RNA
gtgctagatggatcagacagt

SEQ ID NO: 108 - RNA, 21 nt, synthetic construct
  source 1..21: mol_type = other RNA
tgctagatggatcagacagct

SEQ ID NO: 109 - RNA, 21 nt, synthetic construct
  source 1..21: mol_type = other RNA
gatggatcagacagcattggt

SEQ ID NO: 110 - RNA, 21 nt, synthetic construct
  source 1..21: mol_type = other RNA
caacttcacaggagccaaaat

SEQ ID NO: 111 - RNA, 21 nt, synthetic construct
  source 1..21: mol_type = other RNA
aacttcacaggagccaaaaat

SEQ ID NO: 112 - RNA, 21 nt, synthetic construct
  source 1..21: mol_type = other RNA
acttcacaggagccaaaaagt

SEQ ID NO: 113 - RNA, 21 nt, synthetic construct
  source 1..21: mol_type = other RNA
cttcacaggagccaaaaagtt

SEQ ID NO: 114 - RNA, 21 nt, synthetic construct
  source 1..21: mol_type = other RNA
ttcacaggagccaaaaagtgt

SEQ ID NO: 115 - RNA, 21 nt, synthetic construct
  source 1..21: mol_type = other RNA
tcacaggagccaaaaagtgtt

SEQ ID NO: 116 - RNA, 21 nt, synthetic construct
  source 1..21: mol_type = other RNA
cacaggagccaaaaagtgtct

SEQ ID NO: 117 - RNA, 21 nt, synthetic construct
  source 1..21: mol_type = other RNA
acaggagccaaaaagtgtctt

SEQ ID NO: 118 - RNA, 21 nt, synthetic construct
  source 1..21: mol_type = other RNA
caggagccaaaaagtgtctat

SEQ ID NO: 119 - RNA, 21 nt, synthetic construct
  source 1..21: mol_type = other RNA
aggagccaaaaagtgtctagt

SEQ ID NO: 120 - RNA, 21 nt, synthetic construct
  source 1..21: mol_type = other RNA
ggagccaaaaagtgtctagtt

SEQ ID NO: 121 - RNA, 21 nt, synthetic construct
  source 1..21: mol_type = other RNA
gagccaaaaagtgtctagtct

SEQ ID NO: 122 - RNA, 21 nt, synthetic construct
  source 1..21: mol_type = other RNA
agccaaaaagtgtctagtcat

SEQ ID NO: 123 - RNA, 21 nt, synthetic construct
  source 1..21: mol_type = other RNA
gccaaaaagtgtctagtcaat

SEQ ID NO: 124 - RNA, 21 nt, synthetic construct
  source 1..21: mol_type = other RNA
ccaaaaagtgtctagtcaact

SEQ ID NO: 125 - RNA, 21 nt, synthetic construct
  source 1..21: mol_type = other RNA
caaaaagtgtctagtcaactt

SEQ ID NO: 126 - RNA, 21 nt, synthetic construct
  source 1..21: mol_type = other RNA
aaaaagtgtctagtcaacttt

SEQ ID NO: 127 - RNA, 21 nt, synthetic construct
  source 1..21: mol_type = other RNA
aaaagtgtctagtcaacttat

SEQ ID NO: 128 - RNA, 21 nt, synthetic construct
  source 1..21: mol_type = other RNA
aaagtgtctagtcaacttaat

SEQ ID NO: 129 - RNA, 21 nt, synthetic construct
  source 1..21: mol_type = other RNA
aagtgtctagtcaacttaatt

SEQ ID NO: 130 - RNA, 21 nt, synthetic construct
  source 1..21: mol_type = other RNA
agtgtctagtcaacttaattt

SEQ ID NO: 131 - RNA, 21 nt, synthetic construct
  source 1..21: mol_type = other RNA
gtgtctagtcaacttaattgt

SEQ ID NO: 132 - RNA, 21 nt, synthetic construct
  source 1..21: mol_type = other RNA
tgtctagtcaacttaattgat

SEQ ID NO: 133 - RNA, 21 nt, synthetic construct
  source 1..21: mol_type = other RNA
gtctagtcaacttaattgagt

SEQ ID NO: 134 - RNA, 21 nt, synthetic construct
  source 1..21: mol_type = other RNA
agtcaacttaattgagaaggt

SEQ ID NO: 135 - RNA, 21 nt, synthetic construct
  source 1..21: mol_type = other RNA
taattgagaaggtggcaagtt

SEQ ID NO: 136 - RNA, 21 nt, synthetic construct
  source 1..21: mol_type = other RNA
aattgagaaggtggcaagttt

SEQ ID NO: 137 - RNA, 21 nt, synthetic construct
  source 1..21: mol_type = other RNA
gagaaggtggcaagttatggt

SEQ ID NO: 138 - RNA, 21 nt, synthetic construct
  source 1..21: mol_type = other RNA
agaaggtggcaagttatggtt

SEQ ID NO: 139 - RNA, 21 nt, synthetic construct
  source 1..21: mol_type = other RNA
aaggtggcaagttatggtgtt

SEQ ID NO: 140 - RNA, 21 nt, synthetic construct
  source 1..21: mol_type = other RNA
aggtggcaagttatggtgtgt

SEQ ID NO: 141 - RNA, 21 nt, synthetic construct
  source 1..21: mol_type = other RNA
gcaagttatggtgtgaagcct

SEQ ID NO: 142 - RNA, 21 nt, synthetic construct
  source 1..21: mol_type = other RNA
gttatggtgtgaagccaagat

SEQ ID NO: 143 - RNA, 21 nt, synthetic construct
  source 1..21: mol_type = other RNA
atggtgtgaagccaagatatt

SEQ ID NO: 144 - RNA, 21 nt, synthetic construct
  source 1..21: mol_type = other RNA
tggtgtgaagccaagatatgt

SEQ ID NO: 145 - RNA, 21 nt, synthetic construct
  source 1..21: mol_type = other RNA
aaaatttgggtcaaagtgtct

SEQ ID NO: 146 - RNA, 21 nt, synthetic construct
  source 1..21: mol_type = other RNA
aaatttgggtcaaagtgtctt

SEQ ID NO: 147 - RNA, 21 nt, synthetic construct
  source 1..21: mol_type = other RNA
atttgggtcaaagtgtctgat

SEQ ID NO: 148 - RNA, 21 nt, synthetic construct
  source 1..21: mol_type = other RNA
gtaatgcagactgggtcacgt

SEQ ID NO: 149 - RNA, 21 nt, synthetic construct
  source 1..21: mol_type = other RNA
taatgcagactgggtcacgat

SEQ ID NO: 150 - RNA, 21 nt, synthetic construct
  source 1..21: mol_type = other RNA
aatgcagactgggtcacgaat

SEQ ID NO: 151 - RNA, 21 nt, synthetic construct
  source 1..21: mol_type = other RNA
atgcagactgggtcacgaagt

SEQ ID NO: 152 - RNA, 21 nt, synthetic construct
  source 1..21: mol_type = other RNA
aatgaaatcaattatgaagat

SEQ ID NO: 153 - RNA, 21 nt, synthetic construct
  source 1..21: mol_type = other RNA
tgaaatcaattatgaagacct

SEQ ID NO: 154 - RNA, 21 nt, synthetic construct
  source 1..21: mol_type = other RNA
aatcaattatgaagaccacat

SEQ ID NO: 155 - RNA, 21 nt, synthetic construct
  source 1..21: mol_type = other RNA
atcaattatgaagaccacaat

SEQ ID NO: 156 - RNA, 21 nt, synthetic construct
  source 1..21: mol_type = other RNA
tcaattatgaagaccacaagt

SEQ ID NO: 157 - RNA, 21 nt, synthetic construct
  source 1..21: mol_type = other RNA
caattatgaagaccacaagtt

SEQ ID NO: 158 - RNA, 21 nt, synthetic construct
  source 1..21: mol_type = other RNA
aattatgaagaccacaagttt

SEQ ID NO: 159 - RNA, 21 nt, synthetic construct
  source 1..21: mol_type = other RNA
attatgaagaccacaagttgt

SEQ ID NO: 160 - RNA, 21 nt, synthetic construct
  source 1..21: mol_type = other RNA
ttatgaagaccacaagttgat

SEQ ID NO: 161 - RNA, 21 nt, synthetic construct
  source 1..21: mol_type = other RNA
tatgaagaccacaagttgaat

SEQ ID NO: 162 - RNA, 21 nt, synthetic construct
  source 1..21: mol_type = other RNA
atgaagaccacaagttgaagt

SEQ ID NO: 163 - RNA, 21 nt, synthetic construct
  source 1..21: mol_type = other RNA
tgaagaccacaagttgaagtt

SEQ ID NO: 164 - RNA, 21 nt, synthetic construct
  source 1..21: mol_type = other RNA
gaagaccacaagttgaagtct

SEQ ID NO: 165 - RNA, 21 nt, synthetic construct
  source 1..21: mol_type = other RNA
aagaccacaagttgaagtcat

SEQ ID NO: 166 - RNA, 21 nt, synthetic construct
  source 1..21: mol_type = other RNA
agaccacaagttgaagtcagt

SEQ ID NO: 167 - RNA, 21 nt, synthetic construct
  source 1..21: mol_type = other RNA
accacaagttgaagtcagggt

SEQ ID NO: 168 - RNA, 21 nt, synthetic construct
  source 1..21: mol_type = other RNA
ccacaagttgaagtcagggat

SEQ ID NO: 169 - RNA, 21 nt, synthetic construct
  source 1..21: mol_type = other RNA
cacaagttgaagtcagggact

SEQ ID NO: 170 - RNA, 21 nt, synthetic construct
  source 1..21: mol_type = other RNA
acaagttgaagtcagggactt

SEQ ID NO: 171 - RNA, 21 nt, synthetic construct
  source 1..21: mol_type = other RNA
aagttgaagtcagggactaat

SEQ ID NO: 172 - RNA, 21 nt, synthetic construct
  source 1..21: mol_type = other RNA
ttgaagtcagggactaacact

SEQ ID NO: 173 - RNA, 21 nt, synthetic construct
  source 1..21: mol_type = other RNA
tgaagtcagggactaacacct

SEQ ID NO: 174 - RNA, 21 nt, synthetic construct
  source 1..21: mol_type = other RNA
agtcagggactaacaccaagt

SEQ ID NO: 175 - RNA, 21 nt, synthetic construct
  source 1..21: mol_type = other RNA
gtcagggactaacaccaagat

SEQ ID NO: 176 - RNA, 21 nt, synthetic construct
  source 1..21: mol_type = other RNA
ccaggcagtgtacagcatgat

SEQ ID NO: 177 - RNA, 21 nt, synthetic construct
  source 1..21: mol_type = other RNA
caggcagtgtacagcatgatt

SEQ ID NO: 178 - RNA, 21 nt, synthetic construct
  source 1..21: mol_type = other RNA
aggcagtgtacagcatgatgt

SEQ ID NO: 179 - RNA, 21 nt, synthetic construct
  source 1..21: mol_type = other RNA
gcagtgtacagcatgatgagt

SEQ ID NO: 180 - RNA, 21 nt, synthetic construct
  source 1..21: mol_type = other RNA
ctgatggattgcacaacatgt

SEQ ID NO: 181 - RNA, 21 nt, synthetic construct
  source 1..21: mol_type = other RNA
tgatggattgcacaacatggt

SEQ ID NO: 182 - RNA, 21 nt, synthetic construct
  source 1..21: mol_type = other RNA
gatggattgcacaacatgggt

SEQ ID NO: 183 - RNA, 21 nt, synthetic construct
  source 1..21: mol_type = other RNA
atggattgcacaacatgggct

SEQ ID NO: 184 - RNA, 21 nt, synthetic construct
  source 1..21: mol_type = other RNA
tggattgcacaacatgggcgt

SEQ ID NO: 185 - RNA, 21 nt, synthetic construct
  source 1..21: mol_type = other RNA
ggattgcacaacatgggcggt

SEQ ID NO: 186 - RNA, 21 nt, synthetic construct
  source 1..21: mol_type = other RNA
gacccaattactgtcattgat

SEQ ID NO: 187 - RNA, 21 nt, synthetic construct
  source 1..21: mol_type = other RNA
acccaattactgtcattgatt

SEQ ID NO: 188 - RNA, 21 nt, synthetic construct
  source 1..21: mol_type = other RNA
ccaattactgtcattgatgat

SEQ ID NO: 189 - RNA, 21 nt, synthetic construct
  source 1..21: mol_type = other RNA
tgtcattgatgagatccgggt

SEQ ID NO: 190 - RNA, 21 nt, synthetic construct
  source 1..21: mol_type = other RNA
gtcattgatgagatccgggat

SEQ ID NO: 191 - RNA, 21 nt, synthetic construct
  source 1..21: mol_type = other RNA
cattgatgagatccgggactt

SEQ ID NO: 192 - RNA, 21 nt, synthetic construct
  source 1..21: mol_type = other RNA
attgatgagatccgggacttt

SEQ ID NO: 193 - RNA, 21 nt, synthetic construct
  source 1..21: mol_type = other RNA
ttggcaaggatcgcaaaaact

SEQ ID NO: 194 - RNA, 21 nt, synthetic construct
  source 1..21: mol_type = other RNA
tggcaaggatcgcaaaaacct

SEQ ID NO: 195 - RNA, 21 nt, synthetic construct
  source 1..21: mol_type = other RNA
ggcaaggatcgcaaaaaccct

SEQ ID NO: 196 - RNA, 21 nt, synthetic construct
  source 1..21: mol_type = other RNA
caagggaggattatctggatt

SEQ ID NO: 197 - RNA, 21 nt, synthetic construct
  source 1..21: mol_type = other RNA
gaggattatctggatgtctat

SEQ ID NO: 198 - RNA, 21 nt, synthetic construct
  source 1..21: mol_type = other RNA
aggattatctggatgtctatt

SEQ ID NO: 199 - RNA, 21 nt, synthetic construct
  source 1..21: mol_type = other RNA
ggattatctggatgtctatgt

SEQ ID NO: 200 - RNA, 21 nt, synthetic construct
  source 1..21: mol_type = other RNA
gattatctggatgtctatgtt

SEQ ID NO: 201 - RNA, 21 nt, synthetic construct
  source 1..21: mol_type = other RNA
attatctggatgtctatgtgt

SEQ ID NO: 202 - RNA, 21 nt, synthetic construct
  source 1..21: mol_type = other RNA
ttatctggatgtctatgtgtt

SEQ ID NO: 203 - RNA, 21 nt, synthetic construct
  source 1..21: mol_type = other RNA
tatctggatgtctatgtgttt

SEQ ID NO: 204 - RNA, 21 nt, synthetic construct
  source 1..21: mol_type = other RNA
atctggatgtctatgtgtttt

SEQ ID NO: 205 - RNA, 21 nt, synthetic construct
  source 1..21: mol_type = other RNA
tctggatgtctatgtgtttgt

SEQ ID NO: 206 - RNA, 21 nt, synthetic construct
  source 1..21: mol_type = other RNA
ctggatgtctatgtgtttggt

SEQ ID NO: 207 - RNA, 21 nt, synthetic construct
  source 1..21: mol_type = other RNA
aaccaagtgaacatcaatgct

SEQ ID NO: 208 - RNA, 21 nt, synthetic construct
  source 1..21: mol_type = other RNA
accaagtgaacatcaatgctt

SEQ ID NO: 209 - RNA, 21 nt, synthetic construct
  source 1..21: mol_type = other RNA
ccaagtgaacatcaatgcttt

SEQ ID NO: 210 - RNA, 21 nt, synthetic construct
  source 1..21: mol_type = other RNA
caagtgaacatcaatgctttt

SEQ ID NO: 211 - RNA, 21 nt, synthetic construct
  source 1..21: mol_type = other RNA
atcaatgctttggcttccaat

SEQ ID NO: 212 - RNA, 21 nt, synthetic construct
  source 1..21: mol_type = other RNA
tcaatgctttggcttccaagt

SEQ ID NO: 213 - RNA, 21 nt, synthetic construct
  source 1..21: mol_type = other RNA
caatgctttggcttccaagat

SEQ ID NO: 214 - RNA, 21 nt, synthetic construct
  source 1..21: mol_type = other RNA
tggcttccaagaaagacaatt

SEQ ID NO: 215 - RNA, 21 nt, synthetic construct
  source 1..21: mol_type = other RNA
ttccaagaaagacaatgagct

SEQ ID NO: 216 - RNA, 21 nt, synthetic construct
  source 1..21: mol_type = other RNA
tccaagaaagacaatgagcat

SEQ ID NO: 217 - RNA, 21 nt, synthetic construct
  source 1..21: mol_type = other RNA
caagaaagacaatgagcaact

SEQ ID NO: 218 - RNA, 21 nt, synthetic construct
  source 1..21: mol_type = other RNA
aagaaagacaatgagcaacat

SEQ ID NO: 219 - RNA, 21 nt, synthetic construct
  source 1..21: mol_type = other RNA
aaagacaatgagcaacatgtt

SEQ ID NO: 220 - RNA, 21 nt, synthetic construct
  source 1..21: mol_type = other RNA
agacaatgagcaacatgtgtt

SEQ ID NO: 221 - RNA, 21 nt, synthetic construct
  source 1..21: mol_type = other RNA
gacaatgagcaacatgtgttt

SEQ ID NO: 222 - RNA, 21 nt, synthetic construct
  source 1..21: mol_type = other RNA
acaatgagcaacatgtgttct

SEQ ID NO: 223 - RNA, 21 nt, synthetic construct
  source 1..21: mol_type = other RNA
caatgagcaacatgtgttcat

SEQ ID NO: 224 - RNA, 21 nt, synthetic construct
  source 1..21: mol_type = other RNA
atgagcaacatgtgttcaaat

SEQ ID NO: 225 - RNA, 21 nt, synthetic construct
  source 1..21: mol_type = other RNA
gagcaacatgtgttcaaagtt

SEQ ID NO: 226 - RNA, 21 nt, synthetic construct
  source 1..21: mol_type = other RNA
agcaacatgtgttcaaagtct

SEQ ID NO: 227 - RNA, 21 nt, synthetic construct
  source 1..21: mol_type = other RNA
caacatgtgttcaaagtcaat

SEQ ID NO: 228 - RNA, 21 nt, synthetic construct
  source 1..21: mol_type = other RNA
aacatgtgttcaaagtcaagt

SEQ ID NO: 229 - RNA, 21 nt, synthetic construct
  source 1..21: mol_type = other RNA
acatgtgttcaaagtcaaggt

SEQ ID NO: 230 - RNA, 21 nt, synthetic construct
  source 1..21: mol_type = other RNA
atgtgttcaaagtcaaggatt

SEQ ID NO: 231 - RNA, 21 nt, synthetic construct
  source 1..21: mol_type = other RNA
tgtgttcaaagtcaaggatat

SEQ ID NO: 232 - RNA, 21 nt, synthetic construct
  source 1..21: mol_type = other RNA
gtgttcaaagtcaaggatatt

SEQ ID NO: 233 - RNA, 21 nt, synthetic construct
  source 1..21: mol_type = other RNA
ttcaaagtcaaggatatggat

SEQ ID NO: 234 - RNA, 21 nt, synthetic construct
  source 1..21: mol_type = other RNA
tcaaagtcaaggatatggaat

SEQ ID NO: 235 - RNA, 21 nt, synthetic construct
  source 1..21: mol_type = other RNA
caaagtcaaggatatggaaat

SEQ ID NO: 236 - RNA, 21 nt, synthetic construct
  source 1..21: mol_type = other RNA
tgaaagccagtctctgagtct

SEQ ID NO: 237 - RNA, 21 nt, synthetic construct
  source 1..21: mol_type = other RNA
gaaagccagtctctgagtctt

SEQ ID NO: 238 - RNA, 21 nt, synthetic construct
  source 1..21: mol_type = other RNA
tgagtctctgtggcatggttt

SEQ ID NO: 239 - RNA, 21 nt, synthetic construct
  source 1..21: mol_type = other RNA
tctctgtggcatggtttgggt

SEQ ID NO: 240 - RNA, 21 nt, synthetic construct
  source 1..21: mol_type = other RNA
tgtggcatggtttgggaacat

SEQ ID NO: 241 - RNA, 21 nt, synthetic construct
  source 1..21: mol_type = other RNA
tggcatggtttgggaacacat

SEQ ID NO: 242 - RNA, 21 nt, synthetic construct
  source 1..21: mol_type = other RNA
aagggtaccgattaccacaat

SEQ ID NO: 243 - RNA, 21 nt, synthetic construct
  source 1..21: mol_type = other RNA
gggtaccgattaccacaagct

SEQ ID NO: 244 - RNA, 21 nt, synthetic construct
  source 1..21: mol_type = other RNA
taccgattaccacaagcaact

SEQ ID NO: 245 - RNA, 21 nt, synthetic construct
  source 1..21: mol_type = other RNA
ccgattaccacaagcaaccat

SEQ ID NO: 246 - RNA, 21 nt, synthetic construct
  source 1..21: mol_type = other RNA
cgattaccacaagcaaccatt

SEQ ID NO: 247 - RNA, 21 nt, synthetic construct
  source 1..21: mol_type = other RNA
attaccacaagcaaccatggt

SEQ ID NO: 248 - RNA, 21 nt, synthetic construct
  source 1..21: mol_type = other RNA
ttaccacaagcaaccatggct

SEQ ID NO: 249 - RNA, 21 nt, synthetic construct
  source 1..21: mol_type = other RNA
taccacaagcaaccatggcat

SEQ ID NO: 250 - RNA, 21 nt, synthetic construct
  source 1..21: mol_type = other RNA
accacaagcaaccatggcagt

SEQ ID NO: 251 - RNA, 21 nt, synthetic construct
  source 1..21: mol_type = other RNA
aagcaaccatggcaggccaat

SEQ ID NO: 252 - RNA, 21 nt, synthetic construct
  source 1..21: mol_type = other RNA
accatggcaggccaagatctt

SEQ ID NO: 253 - RNA, 21 nt, synthetic construct
  source 1..21: mol_type = other RNA
ccatggcaggccaagatctct

SEQ ID NO: 254 - RNA, 21 nt, synthetic construct
  source 1..21: mol_type = other RNA
catggcaggccaagatctcat

SEQ ID NO: 255 - RNA, 21 nt, synthetic construct
  source 1..21: mol_type = other RNA
gctgtggtgtctgagtacttt

SEQ ID NO: 256 - RNA, 21 nt, synthetic construct
  source 1..21: mol_type = other RNA
ctgtggtgtctgagtactttt

SEQ ID NO: 257 - RNA, 21 nt, synthetic construct
  source 1..21: mol_type = other RNA
tgtggtgtctgagtactttgt

SEQ ID NO: 258 - RNA, 21 nt, synthetic construct
  source 1..21: mol_type = other RNA
gtggtgtctgagtactttgtt

SEQ ID NO: 259 - RNA, 21 nt, synthetic construct
  source 1..21: mol_type = other RNA
tggtgtctgagtactttgtgt

SEQ ID NO: 260 - RNA, 21 nt, synthetic construct
  source 1..21: mol_type = other RNA
ctgacagcagcacattgtttt

SEQ ID NO: 261 - RNA, 21 nt, synthetic construct
  source 1..21: mol_type = other RNA
aagcgggacctggagatagat

SEQ ID NO: 262 - RNA, 21 nt, synthetic construct
  source 1..21: mol_type = other RNA
agcgggacctggagatagaat

SEQ ID NO: 263 - RNA, 21 nt, synthetic construct
  source 1..21: mol_type = other RNA
gaagcaggaattcctgaattt

SEQ ID NO: 264 - RNA, 21 nt, synthetic construct
  source 1..21: mol_type = other RNA
aagcaggaattcctgaatttt

SEQ ID NO: 265 - RNA, 21 nt, synthetic construct
  source 1..21: mol_type = other RNA
gcaggaattcctgaattttat

SEQ ID NO: 266 - RNA, 21 nt, synthetic construct
  source 1..21: mol_type = other RNA
caggaattcctgaattttatt

SEQ ID NO: 267 - RNA, 21 nt, synthetic construct
  source 1..21: mol_type = other RNA
aggaattcctgaattttatgt

SEQ ID NO: 268 - RNA, 21 nt, synthetic construct
  source 1..21: mol_type = other RNA
ggaattcctgaattttatgat

SEQ ID NO: 269 - RNA, 21 nt, synthetic construct
  source 1..21: mol_type = other RNA
gaattcctgaattttatgact

SEQ ID NO: 270 - RNA, 21 nt, synthetic construct
  source 1..21: mol_type = other RNA
aattcctgaattttatgactt

SEQ ID NO: 271 - RNA, 21 nt, synthetic construct
  source 1..21: mol_type = other RNA
attcctgaattttatgactat

SEQ ID NO: 272 - RNA, 21 nt, synthetic construct
  source 1..21: mol_type = other RNA
ttcctgaattttatgactatt

SEQ ID NO: 273 - RNA, 21 nt, synthetic construct
  source 1..21: mol_type = other RNA
tcctgaattttatgactatgt

SEQ ID NO: 274 - RNA, 21 nt, synthetic construct
  source 1..21: mol_type = other RNA
cctgaattttatgactatgat

SEQ ID NO: 275 - RNA, 21 nt, synthetic construct
  source 1..21: mol_type = other RNA
ctgaattttatgactatgact

SEQ ID NO: 276 - RNA, 21 nt, synthetic construct
  source 1..21: mol_type = other RNA
gaattttatgactatgacgtt

SEQ ID NO: 277 - RNA, 21 nt, synthetic construct
  source 1..21: mol_type = other RNA
aattttatgactatgacgttt

SEQ ID NO: 278 - RNA, 21 nt, synthetic construct
  source 1..21: mol_type = other RNA
attttatgactatgacgttgt

SEQ ID NO: 279 - RNA, 21 nt, synthetic construct
  source 1..21: mol_type = other RNA
tttatgactatgacgttgcct

SEQ ID NO: 280 - RNA, 21 nt, synthetic construct
  source 1..21: mol_type = other RNA
ttatgactatgacgttgccct

SEQ ID NO: 281 - RNA, 21 nt, synthetic construct
  source 1..21: mol_type = other RNA
tatgactatgacgttgccctt

SEQ ID NO: 282 - RNA, 21 nt, synthetic construct
  source 1..21: mol_type = other RNA
atgactatgacgttgccctgt

SEQ ID NO: 283 - RNA, 21 nt, synthetic construct
  source 1..21: mol_type = other RNA
tgactatgacgttgccctgat

SEQ ID NO: 284 - RNA, 21 nt, synthetic construct
  source 1..21: mol_type = other RNA
gactatgacgttgccctgatt

SEQ ID NO: 285 - RNA, 21 nt, synthetic construct
  source 1..21: mol_type = other RNA
atgacgttgccctgatcaagt

SEQ ID NO: 286 - RNA, 21 nt, synthetic construct
  source 1..21: mol_type = other RNA
tgacgttgccctgatcaagct

SEQ ID NO: 287 - RNA, 21 nt, synthetic construct
  source 1..21: mol_type = other RNA
gacgttgccctgatcaagctt

SEQ ID NO: 288 - RNA, 21 nt, synthetic construct
  source 1..21: mol_type = other RNA
acgttgccctgatcaagctct

SEQ ID NO: 289 - RNA, 21 nt, synthetic construct
  source 1..21: mol_type = other RNA
gttgccctgatcaagctcaat

SEQ ID NO: 290 - RNA, 21 nt, synthetic construct
  source 1..21: mol_type = other RNA
ttgccctgatcaagctcaagt

SEQ ID NO: 291 - RNA, 21 nt, synthetic construct
  source 1..21: mol_type = other RNA
cagactatcaggcccatttgt

SEQ ID NO: 292 - RNA, 21 nt, synthetic construct
  source 1..21: mol_type = other RNA
agactatcaggcccatttgtt

SEQ ID NO: 293 - RNA, 21 nt, synthetic construct
  source 1..21: mol_type = other RNA
gactatcaggcccatttgtct

SEQ ID NO: 294 - RNA, 21 nt, synthetic construct
  source 1..21: mol_type = other RNA
actatcaggcccatttgtctt

SEQ ID NO: 295 - RNA, 21 nt, synthetic construct
  source 1..21: mol_type = other RNA
ctatcaggcccatttgtctct

SEQ ID NO: 296 - RNA, 21 nt, synthetic construct
  source 1..21: mol_type = other RNA
cgagggaacaactcgagcttt

SEQ ID NO: 297 - RNA, 21 nt, synthetic construct
  source 1..21: mol_type = other RNA
gagggaacaactcgagctttt

SEQ ID NO: 298 - RNA, 21 nt, synthetic construct
  source 1..21: mol_type = other RNA
agggaacaactcgagctttgt

SEQ ID NO: 299 - RNA, 21 nt, synthetic construct
  source 1..21: mol_type = other RNA
gaacaactcgagctttgaggt

SEQ ID NO: 300 - RNA, 21 nt, synthetic construct
  source 1..21: mol_type = other RNA
aacaactcgagctttgaggct

SEQ ID NO: 301 - RNA, 21 nt, synthetic construct
  source 1..21: mol_type = other RNA
caactcgagctttgaggcttt

SEQ ID NO: 302 - RNA, 21 nt, synthetic construct
  source 1..21: mol_type = other RNA
aactcgagctttgaggcttct

SEQ ID NO: 303 - RNA, 21 nt, synthetic construct
  source 1..21: mol_type = other RNA
actcgagctttgaggcttcct

SEQ ID NO: 304 - RNA, 21 nt, synthetic construct
  source 1..21: mol_type = other RNA
gagctttgaggcttcctccat

SEQ ID NO: 305 - RNA, 21 nt, synthetic construct
  source 1..21: mol_type = other RNA
agctttgaggcttcctccaat

SEQ ID NO: 306 - RNA, 21 nt, synthetic construct
  source 1..21: mol_type = other RNA
gctttgaggcttcctccaact

SEQ ID NO: 307 - RNA, 21 nt, synthetic construct
  source 1..21: mol_type = other RNA
ctttgaggcttcctccaactt

SEQ ID NO: 308 - RNA, 21 nt, synthetic construct
  source 1..21: mol_type = other RNA
tttgaggcttcctccaactat

SEQ ID NO: 309 - RNA, 21 nt, synthetic construct
  source 1..21: mol_type = other RNA
gaggcttcctccaactaccat

SEQ ID NO: 310 - RNA, 21 nt, synthetic construct
  source 1..21: mol_type = other RNA
aggcttcctccaactaccact

SEQ ID NO: 311 - RNA, 21 nt, synthetic construct
  source 1..21: mol_type = other RNA
gcttcctccaactaccacttt

SEQ ID NO: 312 - RNA, 21 nt, synthetic construct
  source 1..21: mol_type = other RNA
ttcctccaactaccacttgct

SEQ ID NO: 313 - RNA, 21 nt, synthetic construct
  source 1..21: mol_type = other RNA
tcctccaactaccacttgcct

SEQ ID NO: 314 - RNA, 21 nt, synthetic construct
  source 1..21: mol_type = other RNA
caactaccacttgccagcaat

SEQ ID NO: 315 - RNA, 21 nt, synthetic construct
  source 1..21: mol_type = other RNA
actaccacttgccagcaacat

SEQ ID NO: 316 - RNA, 21 nt, synthetic construct
  source 1..21: mol_type = other RNA
ctccctgcacaggatatcaat

SEQ ID NO: 317 - RNA, 21 nt, synthetic construct
  source 1..21: mol_type = other RNA
tccctgcacaggatatcaaat

SEQ ID NO: 318 - RNA, 21 nt, synthetic construct
  source 1..21: mol_type = other RNA
ccctgcacaggatatcaaagt

SEQ ID NO: 319 - RNA, 21 nt, synthetic construct
  source 1..21: mol_type = other RNA
ctgcacaggatatcaaagctt

SEQ ID NO: 320 - RNA, 21 nt, synthetic construct
  source 1..21: mol_type = other RNA
caggatatcaaagctctgttt

SEQ ID NO: 321 - RNA, 21 nt, synthetic construct
  source 1..21: mol_type = other RNA
gatatcaaagctctgtttgtt

SEQ ID NO: 322 - RNA, 21 nt, synthetic construct
  source 1..21: mol_type = other RNA
aaagctctgtttgtgtctgat

SEQ ID NO: 323 - RNA, 21 nt, synthetic construct
  source 1..21: mol_type = other RNA
gctgactcggaaggaggtctt

SEQ ID NO: 324 - RNA, 21 nt, synthetic construct
  source 1..21: mol_type = other RNA
ctgactcggaaggaggtctat

SEQ ID NO: 325 - RNA, 21 nt, synthetic construct
  source 1..21: mol_type = other RNA
actcggaaggaggtctacatt

SEQ ID NO: 326 - RNA, 21 nt, synthetic construct
  source 1..21: mol_type = other RNA
tcggaaggaggtctacatcat

SEQ ID NO: 327 - RNA, 21 nt, synthetic construct
  source 1..21: mol_type = other RNA
cggaaggaggtctacatcaat

SEQ ID NO: 328 - RNA, 21 nt, synthetic construct
  source 1..21: mol_type = other RNA
aaggaggtctacatcaagaat

SEQ ID NO: 329 - RNA, 21 nt, synthetic construct
  source 1..21: mol_type = other RNA
aggaggtctacatcaagaatt

SEQ ID NO: 330 - RNA, 21 nt, synthetic construct
  source 1..21: mol_type = other RNA
aagaaaggcagctgtgagagt

SEQ ID NO: 331 - RNA, 21 nt, synthetic construct
  source 1..21: mol_type = other RNA
aaaggcagctgtgagagagat

SEQ ID NO: 332 - RNA, 21 nt, synthetic construct
  source 1..21: mol_type = other RNA
agctgtgagagagatgctcat

SEQ ID NO: 333 - RNA, 21 nt, synthetic construct
  source 1..21: mol_type = other RNA
ctgtgagagagatgctcaatt

SEQ ID NO: 334 - RNA, 21 nt, synthetic construct
  source 1..21: mol_type = other RNA
tgtgagagagatgctcaatat

SEQ ID NO: 335 - RNA, 21 nt, synthetic construct
  source 1..21: mol_type = other RNA
gtgagagagatgctcaatatt

SEQ ID NO: 336 - RNA, 21 nt, synthetic construct
  source 1..21: mol_type = other RNA
tgagagagatgctcaatatgt

SEQ ID NO: 337 - RNA, 21 nt, synthetic construct
  source 1..21: mol_type = other RNA
gagagagatgctcaatatgct

SEQ ID NO: 338 - RNA, 21 nt, synthetic construct
  source 1..21: mol_type = other RNA
caggctatgacaaagtcaagt

SEQ ID NO: 339 - RNA, 21 nt, synthetic construct
  source 1..21: mol_type = other RNA
aggctatgacaaagtcaaggt

SEQ ID NO: 340 - RNA, 21 nt, synthetic construct
  source 1..21: mol_type = other RNA
ggctatgacaaagtcaaggat

SEQ ID NO: 341 - RNA, 21 nt, synthetic construct
  source 1..21: mol_type = other RNA
gacaaagtcaaggacatctct

SEQ ID NO: 342 - RNA, 21 nt, synthetic construct
  source 1..21: mol_type = other RNA
tcggttcctttgtactggagt

SEQ ID NO: 343 - RNA, 21 nt, synthetic construct
  source 1..21: mol_type = other RNA
cggttcctttgtactggaggt

SEQ ID NO: 344 - RNA, 21 nt, synthetic construct
  source 1..21: mol_type = other RNA
ggttcctttgtactggaggat

SEQ ID NO: 345 - RNA, 21 nt, synthetic construct
  source 1..21: mol_type = other RNA
ttcctttgtactggaggagtt

SEQ ID NO: 346 - RNA, 21 nt, synthetic construct
  source 1..21: mol_type = other RNA
cctttgtactggaggagtgat

SEQ ID NO: 347 - RNA, 21 nt, synthetic construct
  source 1..21: mol_type = other RNA
ttgtactggaggagtgagtct

SEQ ID NO: 348 - RNA, 21 nt, synthetic construct
  source 1..21: mol_type = other RNA
tgtactggaggagtgagtcct

SEQ ID NO: 349 - RNA, 21 nt, synthetic construct
  source 1..21: mol_type = other RNA
gtactggaggagtgagtccct

SEQ ID NO: 350 - RNA, 21 nt, synthetic construct
  source 1..21: mol_type = other RNA
actggaggagtgagtccctat

SEQ ID NO: 351 - RNA, 21 nt, synthetic construct
  source 1..21: mol_type = other RNA
tggaggagtgagtccctatgt

SEQ ID NO: 352 - RNA, 21 nt, synthetic construct
  source 1..21: mol_type = other RNA
gaggagtgagtccctatgctt

SEQ ID NO: 353 - RNA, 21 nt, synthetic construct
  source 1..21: mol_type = other RNA
ggagtgagtccctatgctgat

SEQ ID NO: 354 - RNA, 21 nt, synthetic construct
  source 1..21: mol_type = other RNA
gagtgagtccctatgctgact

SEQ ID NO: 355 - RNA, 21 nt, synthetic construct
  source 1..21: mol_type = other RNA
caatacttgcagaggtgattt

SEQ ID NO: 356 - RNA, 21 nt, synthetic construct
  source 1..21: mol_type = other RNA
aatacttgcagaggtgattct

SEQ ID NO: 357 - RNA, 21 nt, synthetic construct
  source 1..21: mol_type = other RNA
tacttgcagaggtgattctgt

SEQ ID NO: 358 - RNA, 21 nt, synthetic construct
  source 1..21: mol_type = other RNA
cttgcagaggtgattctggct

SEQ ID NO: 359 - RNA, 21 nt, synthetic construct
  source 1..21: mol_type = other RNA
ttgcagaggtgattctggcgt

SEQ ID NO: 360 - RNA, 21 nt, synthetic construct
  source 1..21: mol_type = other RNA
tgatagttcacaagagaagtt

SEQ ID NO: 361 - RNA, 21 nt, synthetic construct
  source 1..21: mol_type = other RNA
gatagttcacaagagaagtct

SEQ ID NO: 362 - RNA, 21 nt, synthetic construct
  source 1..21: mol_type = other RNA
atagttcacaagagaagtcgt

SEQ ID NO: 363 - RNA, 21 nt, synthetic construct
  source 1..21: mol_type = other RNA
tagttcacaagagaagtcgtt

SEQ ID NO: 364 - RNA, 21 nt, synthetic construct
  source 1..21: mol_type = other RNA
agttcacaagagaagtcgttt

SEQ ID NO: 365 - RNA, 21 nt, synthetic construct
  source 1..21: mol_type = other RNA
gttcacaagagaagtcgtttt

SEQ ID NO: 366 - RNA, 21 nt, synthetic construct
  source 1..21: mol_type = other RNA
ttcacaagagaagtcgtttct

SEQ ID NO: 367 - RNA, 21 nt, synthetic construct
  source 1..21: mol_type = other RNA
tcacaagagaagtcgtttcat

SEQ ID NO: 368 - RNA, 21 nt, synthetic construct
  source 1..21: mol_type = other RNA
cacaagagaagtcgtttcatt

SEQ ID NO: 369 - RNA, 21 nt, synthetic construct
  source 1..21: mol_type = other RNA
acaagagaagtcgtttcattt

SEQ ID NO: 370 - RNA, 21 nt, synthetic construct
  source 1..21: mol_type = other RNA
caagagaagtcgtttcattct

SEQ ID NO: 371 - RNA, 21 nt, synthetic construct
  source 1..21: mol_type = other RNA
aagagaagtcgtttcattcat

SEQ ID NO: 372 - RNA, 21 nt, synthetic construct
  source 1..21: mol_type = other RNA
agagaagtcgtttcattcaat

SEQ ID NO: 373 - RNA, 21 nt, synthetic construct
  source 1..21: mol_type = other RNA
gagaagtcgtttcattcaagt

SEQ ID NO: 374 - RNA, 21 nt, synthetic construct
  source 1..21: mol_type = other RNA
agaagtcgtttcattcaagtt

SEQ ID NO: 375 - RNA, 21 nt, synthetic construct
  source 1..21: mol_type = other RNA
gaagtcgtttcattcaagttt

SEQ ID NO: 376 - RNA, 21 nt, synthetic construct
  source 1..21: mol_type = other RNA
aagtcgtttcattcaagttgt

SEQ ID NO: 377 - RNA, 21 nt, synthetic construct
  source 1..21: mol_type = other RNA
agtcgtttcattcaagttggt

SEQ ID NO: 378 - RNA, 21 nt, synthetic construct
  source 1..21: mol_type = other RNA
gagtagtggatgtctgcaaat

SEQ ID NO: 379 - RNA, 21 nt, synthetic construct
  source 1..21: mol_type = other RNA
agtagtggatgtctgcaaaat

SEQ ID NO: 380 - RNA, 21 nt, synthetic construct
  source 1..21: mol_type = other RNA
gtagtggatgtctgcaaaaat

SEQ ID NO: 381 - RNA, 21 nt, synthetic construct
  source 1..21: mol_type = other RNA
tagtggatgtctgcaaaaact

SEQ ID NO: 382 - RNA, 21 nt, synthetic construct
  source 1..21: mol_type = other RNA
agtggatgtctgcaaaaacct

SEQ ID NO: 383 - RNA, 21 nt, synthetic construct
  source 1..21: mol_type = other RNA
gtggatgtctgcaaaaaccat

SEQ ID NO: 384 - RNA, 21 nt, synthetic construct
  source 1..21: mol_type = other RNA
tggatgtctgcaaaaaccagt

SEQ ID NO: 385 - RNA, 21 nt, synthetic construct
  source 1..21: mol_type = other RNA
ggatgtctgcaaaaaccagat

SEQ ID NO: 386 - RNA, 21 nt, synthetic construct
  source 1..21: mol_type = other RNA
gatgtctgcaaaaaccagaat

SEQ ID NO: 387 - RNA, 21 nt, synthetic construct
  source 1..21: mol_type = other RNA
gtctgcaaaaaccagaagcgt

SEQ ID NO: 388 - RNA, 21 nt, synthetic construct
  source 1..21: mol_type = other RNA
tctgcaaaaaccagaagcggt

SEQ ID NO: 389 - RNA, 21 nt, synthetic construct
  source 1..21: mol_type = other RNA
ctgcaaaaaccagaagcggct

SEQ ID NO: 390 - RNA, 21 nt, synthetic construct
  source 1..21: mol_type = other RNA
caaaaaccagaagcggcaaat

SEQ ID NO: 391 - RNA, 21 nt, synthetic construct
  source 1..21: mol_type = other RNA
aaaaaccagaagcggcaaaat

SEQ ID NO: 392 - RNA, 21 nt, synthetic construct
  source 1..21: mol_type = other RNA
aaaaccagaagcggcaaaagt

SEQ ID NO: 393 - RNA, 21 nt, synthetic construct
  source 1..21: mol_type = other RNA
aaaccagaagcggcaaaagct

SEQ ID NO: 394 - RNA, 21 nt, synthetic construct
  source 1..21: mol_type = other RNA
aaccagaagcggcaaaagcat

SEQ ID NO: 395 - RNA, 21 nt, synthetic construct
  source 1..21: mol_type = other RNA
agaagcggcaaaagcaggtat

SEQ ID NO: 396 - RNA, 21 nt, synthetic construct
  source 1..21: mol_type = other RNA
aaagcaggtacctgctcacgt

SEQ ID NO: 397 - RNA, 21 nt, synthetic construct
  source 1..21: mol_type = other RNA
caagtgctgccctggctgaat

SEQ ID NO: 398 - RNA, 21 nt, synthetic construct
  source 1..21: mol_type = other RNA
tggctgaaggagaaactccat

SEQ ID NO: 399 - RNA, 21 nt, synthetic construct
  source 1..21: mol_type = other RNA
aactccaagatgaggatttgt

SEQ ID NO: 400 - RNA, 21 nt, synthetic construct
  source 1..21: mol_type = other RNA
tccaagatgaggatttgggtt

SEQ ID NO: 401 - RNA, 21 nt, synthetic construct
  source 1..21: mol_type = other RNA
caagatgaggatttgggtttt

SEQ ID NO: 402 - RNA, 21 nt, synthetic construct
  source 1..21: mol_type = other RNA
agatgaggatttgggttttct

SEQ ID NO: 403 - RNA, 21 nt, synthetic construct
  source 1..21: mol_type = other RNA
gtgggattgaattaaaacagt

SEQ ID NO: 404 - RNA, 21 nt, synthetic construct
  source 1..21: mol_type = other RNA
tgggattgaattaaaacagct

SEQ ID NO: 405 - RNA, 21 nt, synthetic construct
  source 1..21: mol_type = other RNA
gggattgaattaaaacagctt

SEQ ID NO: 406 - RNA, 21 nt, synthetic construct
  source 1..21: mol_type = other RNA
attgaattaaaacagctgcgt

SEQ ID NO: 407 - RNA, 21 nt, synthetic construct
  source 1..21: mol_type = other RNA
ttgaattaaaacagctgcgat

SEQ ID NO: 408 - RNA, 21 nt, synthetic construct
  source 1..21: mol_type = other RNA
tgaattaaaacagctgcgact

SEQ ID NO: 409 - RNA, 21 nt, synthetic construct
  source 1..21: mol_type = other RNA
gaattaaaacagctgcgacat

SEQ ID NO: 410 - RNA, 21 nt, synthetic construct
  source 1..21: mol_type = other RNA
aattaaaacagctgcgacaat

SEQ ID NO: 411 - RNA, 21 nt, synthetic construct
  source 1..21: mol_type = other RNA
attaaaacagctgcgacaact

SEQ ID NO: 412 - RNA, 23 nt, synthetic construct
  source 1..23: mol_type = other RNA
  modified_base 7: mod_base = OTHER; note = thymine
aagacctggtcacattcccttcc

SEQ ID NO: 413 - RNA, 23 nt, synthetic construct
  source 1..23: mol_type = other RNA
  modified_base 2: mod_base = OTHER; note = thymine
atagacctggtcacattcccttc

SEQ ID NO: 414 - RNA, 23 nt, synthetic construct
  source 1..23: mol_type = other RNA
  modified_base 12: mod_base = OTHER; note = thymine
actagacctggtcacattccctt

SEQ ID NO: 415 - RNA, 23 nt, synthetic construct
  source 1..23: mol_type = other RNA
acctagacctggtcacattccct

SEQ ID NO: 416 - RNA, 23 nt, synthetic construct
  source 1..23: mol_type = other RNA
acagacctagacctggtcacatt

SEQ ID NO: 417 - RNA, 23 nt, synthetic construct
  source 1..23: mol_type = other RNA
accagacctagacctggtcacat

SEQ ID NO: 418 - RNA, 23 nt, synthetic construct
  source 1..23: mol_type = other RNA
  modified_base 7: mod_base = OTHER; note = thymine
agaaactccagacctagacctgg

SEQ ID NO: 419 - RNA, 23 nt, synthetic construct
  source 1..23: mol_type = other RNA
  modified_base 2: mod_base = OTHER; note = thymine
atccaagctgaaactccagacct

SEQ ID NO: 420 - RNA, 23 nt, synthetic construct
  source 1..23: mol_type = other RNA
agtccaagctgaaactccagacc

SEQ ID NO: 421 - RNA, 23 nt, synthetic construct
  source 1..23: mol_type = other RNA
  modified_base 2: mod_base = OTHER; note = thymine
atgtccaagctgaaactccagac

SEQ ID NO: 422 - RNA, 23 nt, synthetic construct
  source 1..23: mol_type = other RNA
  modified_base 2: mod_base = OTHER; note = thymine
  modified_base 5: mod_base = OTHER; note = thymine
atcttggagaagtcggaaggagc

SEQ ID NO: 423 - RNA, 23 nt, synthetic construct
  source 1..23: mol_type = other RNA
  modified_base 5: mod_base = OTHER; note = thymine
agggtagaagccagaaggacaca

SEQ ID NO: 424 - RNA, 23 nt, synthetic construct
  source 1..23: mol_type = other RNA
  modified_base 7: mod_base = OTHER; note = thymine
aacgggtagaagccagaaggaca

SEQ ID NO: 425 - RNA, 23 nt, synthetic construct
  source 1..23: mol_type = other RNA
  modified_base 2: mod_base = OTHER; note = thymine
atacgggtagaagccagaaggac

SEQ ID NO: 426 - RNA, 23 nt, synthetic construct
  source 1..23: mol_type = other RNA
agtacgggtagaagccagaagga

SEQ ID NO: 427 - RNA, 23 nt, synthetic construct
  source 1..23: mol_type = other RNA
  modified_base 12: mod_base = OTHER; note = thymine
aagggtacgggtagaagccagaa

SEQ ID NO: 428 - RNA, 23 nt, synthetic construct
  source 1..23: mol_type = other RNA
  modified_base 2: mod_base = OTHER; note = thymine
atctgcacagggtacgggtagaa

SEQ ID NO: 429 - RNA, 23 nt, synthetic construct
  source 1..23: mol_type = other RNA
  modified_base 2: mod_base = OTHER; note = thymine
atctgcaggtacgtgtctgcaca

SEQ ID NO: 430 - RNA, 23 nt, synthetic construct
  source 1..23: mol_type = other RNA
  modified_base 7: mod_base = OTHER; note = thymine
aattgctctgcactctgccttcc

SEQ ID NO: 431 - RNA, 23 nt, synthetic construct
  source 1..23: mol_type = other RNA
  modified_base 5: mod_base = OTHER; note = thymine
aggattgctctgcactctgcctt

SEQ ID NO: 432 - RNA, 23 nt, synthetic construct
  source 1..23: mol_type = other RNA
  modified_base 5: mod_base = OTHER; note = thymine
aacattgtagtagggagaccggg

SEQ ID NO: 433 - RNA, 23 nt, synthetic construct
  source 1..23: mol_type = other RNA
  modified_base 2: mod_base = OTHER; note = thymine
  modified_base 12: mod_base = OTHER; note = thymine
atcactcacattgtagtagggag

SEQ ID NO: 434 - RNA, 23 nt, synthetic construct
  source 1..23: mol_type = other RNA
  modified_base 7: mod_base = OTHER; note = thymine
  modified_base 12: mod_base = OTHER; note = thymine
aatcactcacattgtagtaggga

SEQ ID NO: 435 - RNA, 23 nt, synthetic construct
  source 1..23: mol_type = other RNA
acatcactcacattgtagtaggg

SEQ ID NO: 436 - RNA, 23 nt, synthetic construct
  source 1..23: mol_type = other RNA
actcatcactcacattgtagtag

SEQ ID NO: 437 - RNA, 23 nt, synthetic construct
  source 1..23: mol_type = other RNA
agatctcatcactcacattgtag

SEQ ID NO: 438 - RNA, 23 nt, synthetic construct
  source 1..23: mol_type = other RNA
  modified_base 5: mod_base = OTHER; note = thymine
  modified_base 7: mod_base = OTHER; note = thymine
aagatctcatcactcacattgta

SEQ ID NO: 439 - RNA, 23 nt, synthetic construct
  source 1..23: mol_type = other RNA
agagatctcatcactcacattgt

SEQ ID NO: 440 - RNA, 23 nt, synthetic construct
  source 1..23: mol_type = other RNA
  modified_base 7: mod_base = OTHER; note = thymine
  modified_base 12: mod_base = OTHER; note = thymine
aagagatctcatcactcacattg

SEQ ID NO: 441 - RNA, 23 nt, synthetic construct
  source 1..23: mol_type = other RNA
aaagagatctcatcactcacatt

SEQ ID NO: 442 - RNA, 23 nt, synthetic construct
  source 1..23: mol_type = other RNA
aaaagagatctcatcactcacat

SEQ ID NO: 443 - RNA, 23 nt, synthetic construct
  source 1..23: mol_type = other RNA
  modified_base 12: mod_base = OTHER; note = thymine
agaaagagatctcatcactcaca

SEQ ID NO: 444 - RNA, 23 nt, synthetic construct
  source 1..23: mol_type = other RNA
aggaaagagatctcatcactcac

SEQ ID NO: 445 - RNA, 23 nt, synthetic construct
  source 1..23: mol_type = other RNA
  modified_base 2: mod_base = OTHER; note = thymine
  modified_base 12: mod_base = OTHER; note = thymine
atggaaagagatctcatcactca

SEQ ID NO: 446 - RNA, 23 nt, synthetic construct
  source 1..23: mol_type = other RNA
agtggaaagagatctcatcactc

SEQ ID NO: 447 - RNA, 23 nt, synthetic construct
  source 1..23: mol_type = other RNA
aagtggaaagagatctcatcact

SEQ ID NO: 448 - RNA, 23 nt, synthetic construct
  source 1..23: mol_type = other RNA
acatagcagtggaaagagatctc

SEQ ID NO: 449 - RNA, 23 nt, synthetic construct
  source 1..23: mol_type = other RNA
  modified_base 2: mod_base = OTHER; note = thymine
  modified_base 5: mod_base = OTHER; note = thymine
atcatagcagtggaaagagatct

SEQ ID NO: 450 - RNA, 23 nt, synthetic construct
  source 1..23: mol_type = other RNA
  modified_base 12: mod_base = OTHER; note = thymine
agtcatagcagtggaaagagatc

SEQ ID NO: 451 - RNA, 23 nt, synthetic construct
  source 1..23: mol_type = other RNA
  modified_base 7: mod_base = OTHER; note = thymine
acgtcatagcagtggaaagagat

SEQ ID NO: 452 - RNA, 23 nt, synthetic construct
  source 1..23: mol_type = other RNA
  modified_base 5: mod_base = OTHER; note = thymine
accgtcatagcagtggaaagaga

SEQ ID NO: 453 - RNA, 23 nt, synthetic construct
  source 1..23: mol_type = other RNA
  modified_base 12: mod_base = OTHER; note = thymine
aagtgtaaccgtcatagcagtgg

SEQ ID NO: 454 - RNA, 23 nt, synthetic construct
  source 1..23: mol_type = other RNA
  modified_base 5: mod_base = OTHER; note = thymine
  modified_base 7: mod_base = OTHER; note = thymine
agagtgtaaccgtcatagcagtg

SEQ ID NO: 455 - RNA, 23 nt, synthetic construct
  source 1..23: mol_type = other RNA
acggagagtgtaaccgtcatagc

SEQ ID NO: 456 - RNA, 23 nt, synthetic construct
  source 1..23: mol_type = other RNA
  modified_base 12: mod_base = OTHER; note = thymine
accggagagtgtaaccgtcatag

SEQ ID NO: 457 - RNA, 23 nt, synthetic construct
  source 1..23: mol_type = other RNA
aattcacttggcaggtgcgattg

SEQ ID NO: 458 - RNA, 23 nt, synthetic construct
  source 1..23: mol_type = other RNA
  modified_base 5: mod_base = OTHER; note = thymine
acattcacttggcaggtgcgatt

SEQ ID NO: 459 - RNA, 23 nt, synthetic construct
  source 1..23: mol_type = other RNA
  modified_base 5: mod_base = OTHER; note = thymine
accattcacttggcaggtgcgat

SEQ ID NO: 460 - RNA, 23 nt, synthetic construct
  source 1..23: mol_type = other RNA
  modified_base 2: mod_base = OTHER; note = thymine
  modified_base 5: mod_base = OTHER; note = thymine
  modified_base 12: mod_base = OTHER; note = thymine
attgtcacagatcgctgtctgcc

SEQ ID NO: 461 - RNA, 23 nt, synthetic construct
  source 1..23: mol_type = other RNA
agttgtcacagatcgctgtctgc

SEQ ID NO: 462 - RNA, 23 nt, synthetic construct
  source 1..23: mol_type = other RNA
  modified_base 5: mod_base = OTHER; note = thymine
  modified_base 7: mod_base = OTHER; note = thymine
acgttgtcacagatcgctgtctg

SEQ ID NO: 463 - RNA, 23 nt, synthetic construct
  source 1..23: mol_type = other RNA
  modified_base 5: mod_base = OTHER; note = thymine
accgttgtcacagatcgctgtct

SEQ ID NO: 464 - RNA, 23 nt, synthetic construct
  source 1..23: mol_type = other RNA
  modified_base 2: mod_base = OTHER; note = thymine
  modified_base 7: mod_base = OTHER; note = thymine
atccgttgtcacagatcgctgtc

SEQ ID NO: 465 - RNA, 23 nt, synthetic construct
  source 1..23: mol_type = other RNA
  modified_base 7: mod_base = OTHER; note = thymine
actccgttgtcacagatcgctgt

SEQ ID NO: 466 - RNA, 23 nt, synthetic construct
  source 1..23: mol_type = other RNA
  modified_base 2: mod_base = OTHER; note = thymine
atgcccaccttccttgtgccaat

SEQ ID NO: 467 - RNA, 23 nt, synthetic construct
  source 1..23: mol_type = other RNA
  modified_base 2: mod_base = OTHER; note = thymine
  modified_base 12: mod_base = OTHER; note = thymine
atgacgctgtcttcaaggcggta

SEQ ID NO: 468 - RNA, 23 nt, synthetic construct
  source 1..23: mol_type = other RNA
  modified_base 2: mod_base = OTHER; note = thymine
  modified_base 12: mod_base = OTHER; note = thymine
ataggtgacgctgtcttcaaggc

SEQ ID NO: 469 - RNA, 23 nt, synthetic construct
  source 1..23: mol_type = other RNA
  modified_base 7: mod_base = OTHER; note = thymine
agtaggtgacgctgtcttcaagg

SEQ ID NO: 470 - RNA, 23 nt, synthetic construct
  source 1..23: mol_type = other RNA
aggtaggtgacgctgtcttcaag

SEQ ID NO: 471 - RNA, 23 nt, synthetic construct
  source 1..23: mol_type = other RNA
  modified_base 12: mod_base = OTHER; note = thymine
aaagagccaccttcctgacacgt

SEQ ID NO: 472 - RNA, 23 nt, synthetic construct
  source 1..23: mol_type = other RNA
aaaggagtcttggcaggaaggct

SEQ ID NO: 473 - RNA, 23 nt, synthetic construct
  source 1..23: mol_type = other RNA
aatgaaggagtcttggcaggaag

SEQ ID NO: 474 - RNA, 23 nt, synthetic construct
  source 1..23: mol_type = other RNA
  modified_base 5: mod_base = OTHER; note = thymine
aacatgaaggagtcttggcagga

SEQ ID NO: 475 - RNA, 23 nt, synthetic construct
  source 1..23: mol_type = other RNA
  modified_base 2: mod_base = OTHER; note = thymine
atacatgaaggagtcttggcagg

SEQ ID NO: 476 - RNA, 23 nt, synthetic construct
  source 1..23: mol_type = other RNA
  modified_base 2: mod_base = OTHER; note = thymine
  modified_base 5: mod_base = OTHER; note = thymine
atcgtacatgaaggagtcttggc

SEQ ID NO: 477 - RNA, 23 nt, synthetic construct
  source 1..23: mol_type = other RNA
agtcgtacatgaaggagtcttgg

SEQ ID NO: 478 - RNA, 23 nt, synthetic construct
  source 1..23: mol_type = other RNA
  modified_base 2: mod_base = OTHER; note = thymine
  modified_base 7: mod_base = OTHER; note = thymine
atgtcgtacatgaaggagtcttg

SEQ ID NO: 479 - RNA, 23 nt, synthetic construct
  source 1..23: mol_type = other RNA
  modified_base 5: mod_base = OTHER; note = thymine
  modified_base 12: mod_base = OTHER; note = thymine
agtgtcgtacatgaaggagtctt

SEQ ID NO: 480 - RNA, 23 nt, synthetic construct
  source 1..23: mol_type = other RNA
  modified_base 7: mod_base = OTHER; note = thymine
aaaagcttcggccacctcttgag

SEQ ID NO: 481 - RNA, 23 nt, synthetic construct
  source 1..23: mol_type = other RNA
agaagacaggaaagcttcggcca

SEQ ID NO: 482 - RNA, 23 nt, synthetic construct
  source 1..23: mol_type = other RNA
  modified_base 12: mod_base = OTHER; note = thymine
acgactccttctatggtctctgt

SEQ ID NO: 483 - RNA, 23 nt, synthetic construct
  source 1..23: mol_type = other RNA
  modified_base 2: mod_base = OTHER; note = thymine
  modified_base 7: mod_base = OTHER; note = thymine
atcgactccttctatggtctctg

SEQ ID NO: 484 - RNA, 23 nt, synthetic construct
  source 1..23: mol_type = other RNA
  modified_base 12: mod_base = OTHER; note = thymine
aatcgactccttctatggtctct

SEQ ID NO: 485 - RNA, 23 nt, synthetic construct
  source 1..23: mol_type = other RNA
  modified_base 12: mod_base = OTHER; note = thymine
acatcgactccttctatggtctc

SEQ ID NO: 486 - RNA, 23 nt, synthetic construct
  source 1..23: mol_type = other RNA
  modified_base 5: mod_base = OTHER; note = thymine
agcatcgactccttctatggtct

SEQ ID NO: 487 - RNA, 23 nt, synthetic construct
  source 1..23: mol_type = other RNA
  modified_base 5: mod_base = OTHER; note = thymine
aatgttcatggagcctgaagggt

SEQ ID NO: 488 - RNA, 23 nt, synthetic construct
  source 1..23: mol_type = other RNA
  modified_base 2: mod_base = OTHER; note = thymine
  modified_base 12: mod_base = OTHER; note = thymine
atagatgttcatggagcctgaag

SEQ ID NO: 489 - RNA, 23 nt, synthetic construct
  source 1..23: mol_type = other RNA
  modified_base 7: mod_base = OTHER; note = thymine
agtagatgttcatggagcctgaa

SEQ ID NO: 490 - RNA, 23 nt, synthetic construct
  source 1..23: mol_type = other RNA
  modified_base 2: mod_base = OTHER; note = thymine
  modified_base 12: mod_base = OTHER; note = thymine
atagcaccaggtagatgttcatg

SEQ ID NO: 491 - RNA, 23 nt, synthetic construct
  source 1..23: mol_type = other RNA
  modified_base 2: mod_base = OTHER; note = thymine
atctagcaccaggtagatgttca

SEQ ID NO: 492 - RNA, 23 nt, synthetic construct
  source 1..23: mol_type = other RNA
acatctagcaccaggtagatgtt

SEQ ID NO: 493 - RNA, 23 nt, synthetic construct
  source 1..23: mol_type = other RNA
  modified_base 5: mod_base = OTHER; note = thymine
  modified_base 7: mod_base = OTHER; note = thymine
accatctagcaccaggtagatgt

SEQ ID NO: 494 - RNA, 23 nt, synthetic construct
  source 1..23: mol_type = other RNA
  modified_base 2: mod_base = OTHER; note = thymine
atccatctagcaccaggtagatg

SEQ ID NO: 495 - RNA, 23 nt, synthetic construct
  source 1..23: mol_type = other RNA
  modified_base 7: mod_base = OTHER; note = thymine
aatccatctagcaccaggtagat

SEQ ID NO: 496 - RNA, 23 nt, synthetic construct
  source 1..23: mol_type = other RNA
agatccatctagcaccaggtaga

SEQ ID NO: 497 - RNA, 23 nt, synthetic construct
  source 1..23: mol_type = other RNA
  modified_base 2: mod_base = OTHER; note = thymine
  modified_base 5: mod_base = OTHER; note = thymine
atgatccatctagcaccaggtag

SEQ ID NO: 498 - RNA, 23 nt, synthetic construct
  source 1..23: mol_type = other RNA
  modified_base 12: mod_base = OTHER; note = thymine
actgatccatctagcaccaggta

SEQ ID NO: 499 - RNA, 23 nt, synthetic construct
  source 1..23: mol_type = other RNA
  modified_base 5: mod_base = OTHER; note = thymine
  modified_base 12: mod_base = OTHER; note = thymine
agtctgatccatctagcaccagg

SEQ ID NO: 500 - RNA, 23 nt, synthetic construct
  source 1..23: mol_type = other RNA
  modified_base 5: mod_base = OTHER; note = thymine
  modified_base 7: mod_base = OTHER; note = thymine
actgtctgatccatctagcacca

SEQ ID NO: 501 - RNA, 23 nt, synthetic construct
  source 1..23: mol_type = other RNA
agctgtctgatccatctagcacc

SEQ ID NO: 502 - RNA, 23 nt, synthetic construct
  source 1..23: mol_type = other RNA
accaatgctgtctgatccatcta

SEQ ID NO: 503 - RNA, 23 nt, synthetic construct
  source 1..23: mol_type = other RNA
  modified_base 2: mod_base = OTHER; note = thymine
  modified_base 5: mod_base = OTHER; note = thymine
  modified_base 12: mod_base = OTHER; note = thymine
attttggctcctgtgaagttgct

SEQ ID NO: 504 - RNA, 23 nt, synthetic construct
  source 1..23: mol_type = other RNA
  modified_base 2: mod_base = OTHER; note = thymine
  modified_base 5: mod_base = OTHER; note = thymine
atttttggctcctgtgaagttgc

SEQ ID NO: 505 - RNA, 23 nt, synthetic construct
  source 1..23: mol_type = other RNA
  modified_base 5: mod_base = OTHER; note = thymine
  modified_base 7: mod_base = OTHER; note = thymine
actttttggctcctgtgaagttg

SEQ ID NO: 506 - RNA, 23 nt, synthetic construct
  source 1..23: mol_type = other RNA
  modified_base 5: mod_base = OTHER; note = thymine
  modified_base 7: mod_base = OTHER; note = thymine
  modified_base 12: mod_base = OTHER; note = thymine
aactttttggctcctgtgaagtt

SEQ ID NO: 507 - RNA, 23 nt, synthetic construct
  source 1..23: mol_type = other RNA
  modified_base 5: mod_base = OTHER; note = thymine
  modified_base 7: mod_base = OTHER; note = thymine
acactttttggctcctgtgaagt

SEQ ID NO: 508 - RNA, 23 nt, synthetic construct
  source 1..23: mol_type = other RNA
  modified_base 7: mod_base = OTHER; note = thymine
aacactttttggctcctgtgaag

SEQ ID NO: 509 - RNA, 23 nt, synthetic construct
  source 1..23: mol_type = other RNA
  modified_base 7: mod_base = OTHER; note = thymine
agacactttttggctcctgtgaa

SEQ ID NO: 510 - RNA, 23 nt, synthetic construct
  source 1..23: mol_type = other RNA
  modified_base 12: mod_base = OTHER; note = thymine
aagacactttttggctcctgtga

SEQ ID NO: 511 - RNA, 23 nt, synthetic construct
  source 1..23: mol_type = other RNA
  modified_base 2: mod_base = OTHER; note = thymine
  modified_base 12: mod_base = OTHER; note = thymine
atagacactttttggctcctgtg

SEQ ID NO: 512 - RNA, 23 nt, synthetic construct
  source 1..23: mol_type = other RNA
  modified_base 12: mod_base = OTHER; note = thymine
actagacactttttggctcctgt

SEQ ID NO: 513 - RNA, 23 nt, synthetic construct
  source 1..23: mol_type = other RNA
  modified_base 12: mod_base = OTHER; note = thymine
aactagacactttttggctcctg

SEQ ID NO: 514 - RNA, 23 nt, synthetic construct
  source 1..23: mol_type = other RNA
  modified_base 5: mod_base = OTHER; note = thymine
  modified_base 12: mod_base = OTHER; note = thymine
agactagacactttttggctcct

SEQ ID NO: 515 - RNA, 23 nt, synthetic construct
  source 1..23: mol_type = other RNA
  modified_base 2: mod_base = OTHER; note = thymine
atgactagacactttttggctcc

SEQ ID NO: 516 - RNA, 23 nt, synthetic construct
  source 1..23: mol_type = other RNA
  modified_base 2: mod_base = OTHER; note = thymine
  modified_base 7: mod_base = OTHER; note = thymine
attgactagacactttttggctc

SEQ ID NO: 517 - RNA, 23 nt, synthetic construct
  source 1..23: mol_type = other RNA
agttgactagacactttttggct

SEQ ID NO: 518 - RNA, 23 nt, synthetic construct
  source 1..23: mol_type = other RNA
  modified_base 5: mod_base = OTHER; note = thymine
aagttgactagacactttttggc

SEQ ID NO: 519 - RNA, 23 nt, synthetic construct
  source 1..23: mol_type = other RNA
  modified_base 5: mod_base = OTHER; note = thymine
aaagttgactagacactttttgg

SEQ ID NO: 520 - RNA, 23 nt, synthetic construct
  source 1..23: mol_type = other RNA
  modified_base 2: mod_base = OTHER; note = thymine
  modified_base 7: mod_base = OTHER; note = thymine
ataagttgactagacactttttg

SEQ ID NO: 521 - RNA, 23 nt, synthetic construct
  source 1..23: mol_type = other RNA
  modified_base 2: mod_base = OTHER; note = thymine
  modified_base 7: mod_base = OTHER; note = thymine
  modified_base 12: mod_base = OTHER; note = thymine
attaagttgactagacacttttt

SEQ ID NO: 522 - RNA, 23 nt, synthetic construct
  source 1..23: mol_type = other RNA
aattaagttgactagacactttt

SEQ ID NO: 523 - RNA, 23 nt, synthetic construct
  source 1..23: mol_type = other RNA
  modified_base 5: mod_base = OTHER; note = thymine
aaattaagttgactagacacttt

SEQ ID NO: 524 - RNA, 23 nt, synthetic construct
  source 1..23: mol_type = other RNA
  modified_base 5: mod_base = OTHER; note = thymine
acaattaagttgactagacactt

SEQ ID NO: 525 - RNA, 23 nt, synthetic construct
  source 1..23: mol_type = other RNA
  modified_base 2: mod_base = OTHER; note = thymine
  modified_base 7: mod_base = OTHER; note = thymine
  modified_base 12: mod_base = OTHER; note = thymine
atcaattaagttgactagacact

SEQ ID NO: 526 - RNA, 23 nt, synthetic construct
  source 1..23: mol_type = other RNA
  modified_base 7: mod_base = OTHER; note = thymine
  modified_base 12: mod_base = OTHER; note = thymine
actcaattaagttgactagacac

SEQ ID NO: 527 - RNA, 23 nt, synthetic construct
  source 1..23: mol_type = other RNA
  modified_base 5: mod_base = OTHER; note = thymine
  modified_base 7: mod_base = OTHER; note = thymine
  modified_base 12: mod_base = OTHER; note = thymine
accttctcaattaagttgactag

SEQ ID NO: 528 - RNA, 23 nt, synthetic construct
  source 1..23: mol_type = other RNA
  modified_base 5: mod_base = OTHER; note = thymine
  modified_base 12: mod_base = OTHER; note = thymine
aacttgccaccttctcaattaag

SEQ ID NO: 529 - RNA, 23 nt, synthetic construct
  source 1..23: mol_type = other RNA
  modified_base 5: mod_base = OTHER; note = thymine
aaacttgccaccttctcaattaa

SEQ ID NO: 530 - RNA, 23 nt, synthetic construct
  source 1..23: mol_type = other RNA
  modified_base 5: mod_base = OTHER; note = thymine
accataacttgccaccttctcaa

SEQ ID NO: 531 - RNA, 23 nt, synthetic construct
  source 1..23: mol_type = other RNA
aaccataacttgccaccttctca

SEQ ID NO: 532 - RNA, 23 nt, synthetic construct
  source 1..23: mol_type = other RNA
  modified_base 12: mod_base = OTHER; note = thymine
aacaccataacttgccaccttct

SEQ ID NO: 533 - RNA, 23 nt, synthetic construct
  source 1..23: mol_type = other RNA
acacaccataacttgccaccttc

SEQ ID NO: 534 - RNA, 23 nt, synthetic construct
  source 1..23: mol_type = other RNA
  modified_base 5: mod_base = OTHER; note = thymine
aggcttcacaccataacttgcca

SEQ ID NO: 535 - RNA, 23 nt, synthetic construct
  source 1..23: mol_type = other RNA
  modified_base 2: mod_base = OTHER; note = thymine
  modified_base 5: mod_base = OTHER; note = thymine
atcttggcttcacaccataactt

SEQ ID NO: 536 - RNA, 23 nt, synthetic construct
  source 1..23: mol_type = other RNA
  modified_base 5: mod_base = OTHER; note = thymine
  modified_base 7: mod_base = OTHER; note = thymine
  modified_base 12: mod_base = OTHER; note = thymine
aatatcttggcttcacaccataa

SEQ ID NO: 537 - RNA, 23 nt, synthetic construct
  source 1..23: mol_type = other RNA
acatatcttggcttcacaccata

SEQ ID NO: 538 - RNA, 23 nt, synthetic construct
  source 1..23: mol_type = other RNA
  modified_base 7: mod_base = OTHER; note = thymine
agacactttgacccaaattttgg

SEQ ID NO: 539 - RNA, 23 nt, synthetic construct
  source 1..23: mol_type = other RNA
aagacactttgacccaaattttg

SEQ ID NO: 540 - RNA, 23 nt, synthetic construct
  source 1..23: mol_type = other RNA
  modified_base 2: mod_base = OTHER; note = thymine
  modified_base 12: mod_base = OTHER; note = thymine
atcagacactttgacccaaattt

SEQ ID NO: 541 - RNA, 23 nt, synthetic construct
  source 1..23: mol_type = other RNA
  modified_base 12: mod_base = OTHER; note = thymine
acgtgacccagtctgcattactg

SEQ ID NO: 542 - RNA, 23 nt, synthetic construct
  source 1..23: mol_type = other RNA
  modified_base 2: mod_base = OTHER; note = thymine
  modified_base 5: mod_base = OTHER; note = thymine
atcgtgacccagtctgcattact

SEQ ID NO: 543 - RNA, 23 nt, synthetic construct
  source 1..23: mol_type = other RNA
  modified_base 2: mod_base = OTHER; note = thymine
attcgtgacccagtctgcattac

SEQ ID NO: 544 - RNA, 23 nt, synthetic construct
  source 1..23: mol_type = other RNA
  modified_base 7: mod_base = OTHER; note = thymine
acttcgtgacccagtctgcatta

SEQ ID NO: 545 - RNA, 23 nt, synthetic construct
  source 1..23: mol_type = other RNA
  modified_base 2: mod_base = OTHER; note = thymine
  modified_base 5: mod_base = OTHER; note = thymine
  modified_base 12: mod_base = OTHER; note = thymine
atcttcataattgatttcattga

SEQ ID NO: 546 - RNA, 23 nt, synthetic construct
  source 1..23: mol_type = other RNA
  modified_base 7: mod_base = OTHER; note = thymine
aggtcttcataattgatttcatt

SEQ ID NO: 547 - RNA, 23 nt, synthetic construct
  source 1..23: mol_type = other RNA
  modified_base 2: mod_base = OTHER; note = thymine
  modified_base 7: mod_base = OTHER; note = thymine
atgtggtcttcataattgatttc

SEQ ID NO: 548 - RNA, 23 nt, synthetic construct
  source 1..23: mol_type = other RNA
  modified_base 2: mod_base = OTHER; note = thymine
  modified_base 5: mod_base = OTHER; note = thymine
attgtggtcttcataattgattt

SEQ ID NO: 549 - RNA, 23 nt, synthetic construct
  source 1..23: mol_type = other RNA
  modified_base 12: mod_base = OTHER; note = thymine
acttgtggtcttcataattgatt

SEQ ID NO: 550 - RNA, 23 nt, synthetic construct
  source 1..23: mol_type = other RNA
  modified_base 5: mod_base = OTHER; note = thymine
  modified_base 7: mod_base = OTHER; note = thymine
  modified_base 12: mod_base = OTHER; note = thymine
aacttgtggtcttcataattgat

SEQ ID NO: 551 - RNA, 23 nt, synthetic construct
  source 1..23: mol_type = other RNA
  modified_base 5: mod_base = OTHER; note = thymine
aaacttgtggtcttcataattga

SEQ ID NO: 552 - RNA, 23 nt, synthetic construct
  source 1..23: mol_type = other RNA
  modified_base 7: mod_base = OTHER; note = thymine
  modified_base 12: mod_base = OTHER; note = thymine
acaacttgtggtcttcataattg

SEQ ID NO: 553 - RNA, 23 nt, synthetic construct
  source 1..23: mol_type = other RNA
  modified_base 2: mod_base = OTHER; note = thymine
  modified_base 7: mod_base = OTHER; note = thymine
atcaacttgtggtcttcataatt

SEQ ID NO: 554 - RNA, 23 nt, synthetic construct
  source 1..23: mol_type = other RNA
  modified_base 2: mod_base = OTHER; note = thymine
attcaacttgtggtcttcataat

SEQ ID NO: 555 - RNA, 23 nt, synthetic construct
  source 1..23: mol_type = other RNA
  modified_base 12: mod_base = OTHER; note = thymine
acttcaacttgtggtcttcataa

SEQ ID NO: 556 - RNA, 23 nt, synthetic construct
  source 1..23: mol_type = other RNA
  modified_base 5: mod_base = OTHER; note = thymine
aacttcaacttgtggtcttcata

SEQ ID NO: 557 - RNA, 23 nt, synthetic construct
  source 1..23: mol_type = other RNA
  modified_base 5: mod_base = OTHER; note = thymine
  modified_base 12: mod_base = OTHER; note = thymine
agacttcaacttgtggtcttcat

SEQ ID NO: 558 - RNA, 23 nt, synthetic construct
  source 1..23: mol_type = other RNA
  modified_base 2: mod_base = OTHER; note = thymine
  modified_base 7: mod_base = OTHER; note = thymine
  modified_base 12: mod_base = OTHER; note = thymine
atgacttcaacttgtggtcttca

SEQ ID NO: 559 - RNA, 23 nt, synthetic construct
  source 1..23: mol_type = other RNA
  modified_base 7: mod_base = OTHER; note = thymine
actgacttcaacttgtggtcttc

SEQ ID NO: 560 - RNA, 23 nt, synthetic construct
  source 1..23: mol_type = other RNA
  modified_base 5: mod_base = OTHER; note = thymine
accctgacttcaacttgtggtct

SEQ ID NO: 561 - RNA, 23 nt, synthetic construct
  source 1..23: mol_type = other RNA
  modified_base 2: mod_base = OTHER; note = thymine
atccctgacttcaacttgtggtc

SEQ ID NO: 562 - RNA, 23 nt, synthetic construct
  source 1..23: mol_type = other RNA
  modified_base 7: mod_base = OTHER; note = thymine
  modified_base 12: mod_base = OTHER; note = thymine
agtccctgacttcaacttgtggt

SEQ ID NO: 563 - RNA, 23 nt, synthetic construct
  source 1..23: mol_type = other RNA
  modified_base 12: mod_base = OTHER; note = thymine
aagtccctgacttcaacttgtgg

SEQ ID NO: 564 - RNA, 23 nt, synthetic construct
  source 1..23: mol_type = other RNA
  modified_base 2: mod_base = OTHER; note = thymine
attagtccctgacttcaacttgt

SEQ ID NO: 565 - RNA, 23 nt, synthetic construct
  source 1..23: mol_type = other RNA
  modified_base 5: mod_base = OTHER; note = thymine
agtgttagtccctgacttcaact

SEQ ID NO: 566 - RNA, 23 nt, synthetic construct
  source 1..23: mol_type = other RNA
  modified_base 7: mod_base = OTHER; note = thymine
aggtgttagtccctgacttcaac

SEQ ID NO: 567 - RNA, 23 nt, synthetic construct
  source 1..23: mol_type = other RNA
  modified_base 7: mod_base = OTHER; note = thymine
acttggtgttagtccctgacttc

SEQ ID NO: 568 - RNA, 23 nt, synthetic construct
  source 1..23: mol_type = other RNA
  modified_base 2: mod_base = OTHER; note = thymine
  modified_base 5: mod_base = OTHER; note = thymine
atcttggtgttagtccctgactt

SEQ ID NO: 569 - RNA, 23 nt, synthetic construct
  source 1..23: mol_type = other RNA
  modified_base 2: mod_base = OTHER; note = thymine
  modified_base 5: mod_base = OTHER; note = thymine
atcatgctgtacactgcctggag

SEQ ID NO: 570 - RNA, 23 nt, synthetic construct
  source 1..23: mol_type = other RNA
aatcatgctgtacactgcctgga

SEQ ID NO: 571 - RNA, 23 nt, synthetic construct
  source 1..23: mol_type = other RNA
  modified_base 7: mod_base = OTHER; note = thymine
  modified_base 12: mod_base = OTHER; note = thymine
acatcatgctgtacactgcctgg

SEQ ID NO: 572 - RNA, 23 nt, synthetic construct
  source 1..23: mol_type = other RNA
  modified_base 12: mod_base = OTHER; note = thymine
actcatcatgctgtacactgcct

SEQ ID NO: 573 - RNA, 23 nt, synthetic construct
  source 1..23: mol_type = other RNA
  modified_base 7: mod_base = OTHER; note = thymine
acatgttgtgcaatccatcagtc

SEQ ID NO: 574 - RNA, 23 nt, synthetic construct
  source 1..23: mol_type = other RNA
  modified_base 5: mod_base = OTHER; note = thymine
  modified_base 7: mod_base = OTHER; note = thymine
accatgttgtgcaatccatcagt

SEQ ID NO: 575 - RNA, 23 nt, synthetic construct
  source 1..23: mol_type = other RNA
acccatgttgtgcaatccatcag

SEQ ID NO: 576 - RNA, 23 nt, synthetic construct
  source 1..23: mol_type = other RNA
  modified_base 7: mod_base = OTHER; note = thymine
  modified_base 12: mod_base = OTHER; note = thymine
agcccatgttgtgcaatccatca

SEQ ID NO: 577 - RNA, 23 nt, synthetic construct
  source 1..23: mol_type = other RNA
acgcccatgttgtgcaatccatc

SEQ ID NO: 578 - RNA, 23 nt, synthetic construct
  source 1..23: mol_type = other RNA
  modified_base 12: mod_base = OTHER; note = thymine
accgcccatgttgtgcaatccat

SEQ ID NO: 579 - RNA, 23 nt, synthetic construct
  source 1..23: mol_type = other RNA
  modified_base 2: mod_base = OTHER; note = thymine
  modified_base 12: mod_base = OTHER; note = thymine
atcaatgacagtaattgggtccc

SEQ ID NO: 580 - RNA, 23 nt, synthetic construct
  source 1..23: mol_type = other RNA
  modified_base 7: mod_base = OTHER; note = thymine
aatcaatgacagtaattgggtcc

SEQ ID NO: 581 - RNA, 23 nt, synthetic construct
  source 1..23: mol_type = other RNA
  modified_base 2: mod_base = OTHER; note = thymine
  modified_base 5: mod_base = OTHER; note = thymine
atcatcaatgacagtaattgggt

SEQ ID NO: 582 - RNA, 23 nt, synthetic construct
  source 1..23: mol_type = other RNA
acccggatctcatcaatgacagt

SEQ ID NO: 583 - RNA, 23 nt, synthetic construct
  source 1..23: mol_type = other RNA
  modified_base 2: mod_base = OTHER; note = thymine
atcccggatctcatcaatgacag

SEQ ID NO: 584 - RNA, 23 nt, synthetic construct
  source 1..23: mol_type = other RNA
aagtcccggatctcatcaatgac

SEQ ID NO: 585 - RNA, 23 nt, synthetic construct
  source 1..23: mol_type = other RNA
  modified_base 5: mod_base = OTHER; note = thymine
  modified_base 12: mod_base = OTHER; note = thymine
aaagtcccggatctcatcaatga

SEQ ID NO: 586 - RNA, 23 nt, synthetic construct
  source 1..23: mol_type = other RNA
  modified_base 5: mod_base = OTHER; note = thymine
  modified_base 7: mod_base = OTHER; note = thymine
  modified_base 12: mod_base = OTHER; note = thymine
agtttttgcgatccttgccaatg

SEQ ID NO: 587 - RNA, 23 nt, synthetic construct
  source 1..23: mol_type = other RNA
  modified_base 5: mod_base = OTHER; note = thymine
  modified_base 7: mod_base = OTHER; note = thymine
aggtttttgcgatccttgccaat

SEQ ID NO: 588 - RNA, 23 nt, synthetic construct
  source 1..23: mol_type = other RNA
  modified_base 5: mod_base = OTHER; note = thymine
  modified_base 7: mod_base = OTHER; note = thymine
agggtttttgcgatccttgccaa

SEQ ID NO: 589 - RNA, 23 nt, synthetic construct
  source 1..23: mol_type = other RNA
  modified_base 12: mod_base = OTHER; note = thymine
aatccagataatcctcccttggg

SEQ ID NO: 590 - RNA, 23 nt, synthetic construct
  source 1..23: mol_type = other RNA
  modified_base 2: mod_base = OTHER; note = thymine
atagacatccagataatcctccc

SEQ ID NO: 591 - RNA, 23 nt, synthetic construct
  source 1..23: mol_type = other RNA
aatagacatccagataatcctcc

SEQ ID NO: 592 - RNA, 23 nt, synthetic construct
  source 1..23: mol_type = other RNA
acatagacatccagataatcctc

SEQ ID NO: 593 - RNA, 23 nt, synthetic construct
  source 1..23: mol_type = other RNA
  modified_base 5: mod_base = OTHER; note = thymine
aacatagacatccagataatcct

SEQ ID NO: 594 - RNA, 23 nt, synthetic construct
  source 1..23: mol_type = other RNA
  modified_base 12: mod_base = OTHER; note = thymine
acacatagacatccagataatcc

SEQ ID NO: 595 - RNA, 23 nt, synthetic construct
  source 1..23: mol_type = other RNA
  modified_base 7: mod_base = OTHER; note = thymine
aacacatagacatccagataatc

SEQ ID NO: 596 - RNA, 23 nt, synthetic construct
  source 1..23: mol_type = other RNA
aaacacatagacatccagataat

SEQ ID NO: 597 - RNA, 23 nt, synthetic construct
  source 1..23: mol_type = other RNA
aaaacacatagacatccagataa

SEQ ID NO: 598 - RNA, 23 nt, synthetic construct
  source 1..23: mol_type = other RNA
acaaacacatagacatccagata

SEQ ID NO: 599 - RNA, 23 nt, synthetic construct
  source 1..23: mol_type = other RNA
accaaacacatagacatccagat

SEQ ID NO: 600 - RNA, 23 nt, synthetic construct
  source 1..23: mol_type = other RNA
  modified_base 5: mod_base = OTHER; note = thymine
  modified_base 12: mod_base = OTHER; note = thymine
agcattgatgttcacttggttca

SEQ ID NO: 601 - RNA, 23 nt, synthetic construct
  source 1..23: mol_type = other RNA
  modified_base 7: mod_base = OTHER; note = thymine
  modified_base 12: mod_base = OTHER; note = thymine
aagcattgatgttcacttggttc

SEQ ID NO: 602 - RNA, 23 nt, synthetic construct
  source 1..23: mol_type = other RNA
  modified_base 7: mod_base = OTHER; note = thymine
aaagcattgatgttcacttggtt

SEQ ID NO: 603 - RNA, 23 nt, synthetic construct
  source 1..23: mol_type = other RNA
  modified_base 12: mod_base = OTHER; note = thymine
aaaagcattgatgttcacttggt

SEQ ID NO: 604 - RNA, 23 nt, synthetic construct
  source 1..23: mol_type = other RNA
  modified_base 2: mod_base = OTHER; note = thymine
attggaagccaaagcattgatgt

SEQ ID NO: 605 - RNA, 23 nt, synthetic construct
  source 1..23: mol_type = other RNA
acttggaagccaaagcattgatg

SEQ ID NO: 606 - RNA, 23 nt, synthetic construct
  source 1..23: mol_type = other RNA
  modified_base 2: mod_base = OTHER; note = thymine
  modified_base 5: mod_base = OTHER; note = thymine
atcttggaagccaaagcattgat

SEQ ID NO: 607 - RNA, 23 nt, synthetic construct
  source 1..23: mol_type = other RNA
  modified_base 12: mod_base = OTHER; note = thymine
aattgtctttcttggaagccaaa

SEQ ID NO: 608 - RNA, 23 nt, synthetic construct
  source 1..23: mol_type = other RNA
  modified_base 7: mod_base = OTHER; note = thymine
  modified_base 12: mod_base = OTHER; note = thymine
agctcattgtctttcttggaagc

SEQ ID NO: 609 - RNA, 23 nt, synthetic construct
  source 1..23: mol_type = other RNA
  modified_base 2: mod_base = OTHER; note = thymine
  modified_base 5: mod_base = OTHER; note = thymine
atgctcattgtctttcttggaag

SEQ ID NO: 610 - RNA, 23 nt, synthetic construct
  source 1..23: mol_type = other RNA
  modified_base 7: mod_base = OTHER; note = thymine
agttgctcattgtctttcttgga

SEQ ID NO: 611 - RNA, 23 nt, synthetic construct
  source 1..23: mol_type = other RNA
  modified_base 2: mod_base = OTHER; note = thymine
  modified_base 5: mod_base = OTHER; note = thymine
  modified_base 12: mod_base = OTHER; note = thymine
atgttgctcattgtctttcttgg

SEQ ID NO: 612 - RNA, 23 nt, synthetic construct
  source 1..23: mol_type = other RNA
  modified_base 5: mod_base = OTHER; note = thymine
  modified_base 7: mod_base = OTHER; note = thymine
aacatgttgctcattgtctttct

SEQ ID NO: 613 - RNA, 23 nt, synthetic construct
  source 1..23: mol_type = other RNA
  modified_base 7: mod_base = OTHER; note = thymine
aacacatgttgctcattgtcttt

SEQ ID NO: 614 - RNA, 23 nt, synthetic construct
  source 1..23: mol_type = other RNA
aaacacatgttgctcattgtctt

SEQ ID NO: 615 - RNA, 23 nt, synthetic construct
  source 1..23: mol_type = other RNA
  modified_base 12: mod_base = OTHER; note = thymine
agaacacatgttgctcattgtct

SEQ ID NO: 616 - RNA, 23 nt, synthetic construct
  source 1..23: mol_type = other RNA
  modified_base 2: mod_base = OTHER; note = thymine
  modified_base 12: mod_base = OTHER; note = thymine
atgaacacatgttgctcattgtc

SEQ ID NO: 617 - RNA, 23 nt, synthetic construct
  source 1..23: mol_type = other RNA
  modified_base 2: mod_base = OTHER; note = thymine
  modified_base 12: mod_base = OTHER; note = thymine
atttgaacacatgttgctcattg

SEQ ID NO: 618 - RNA, 23 nt, synthetic construct
  source 1..23: mol_type = other RNA
  modified_base 5: mod_base = OTHER; note = thymine
aactttgaacacatgttgctcat

SEQ ID NO: 619 - RNA, 23 nt, synthetic construct
  source 1..23: mol_type = other RNA
  modified_base 5: mod_base = OTHER; note = thymine
  modified_base 7: mod_base = OTHER; note = thymine
agactttgaacacatgttgctca

SEQ ID NO: 620 - RNA, 23 nt, synthetic construct
  source 1..23: mol_type = other RNA
  modified_base 2: mod_base = OTHER; note = thymine
  modified_base 7: mod_base = OTHER; note = thymine
attgactttgaacacatgttgct

SEQ ID NO: 621 - RNA, 23 nt, synthetic construct
  source 1..23: mol_type = other RNA
acttgactttgaacacatgttgc

SEQ ID NO: 622 - RNA, 23 nt, synthetic construct
  source 1..23: mol_type = other RNA
  modified_base 5: mod_base = OTHER; note = thymine
accttgactttgaacacatgttg

SEQ ID NO: 623 - RNA, 23 nt, synthetic construct
  source 1..23: mol_type = other RNA
  modified_base 7: mod_base = OTHER; note = thymine
  modified_base 12: mod_base = OTHER; note = thymine
aatccttgactttgaacacatgt

SEQ ID NO: 624 - RNA, 23 nt, synthetic construct
  source 1..23: mol_type = other RNA
  modified_base 2: mod_base = OTHER; note = thymine
  modified_base 7: mod_base = OTHER; note = thymine
  modified_base 12: mod_base = OTHER; note = thymine
atatccttgactttgaacacatg

SEQ ID NO: 625 - RNA, 23 nt, synthetic construct
  source 1..23: mol_type = other RNA
  modified_base 5: mod_base = OTHER; note = thymine
aatatccttgactttgaacacat

SEQ ID NO: 626 - RNA, 23 nt, synthetic construct
  source 1..23: mol_type = other RNA
  modified_base 2: mod_base = OTHER; note = thymine
  modified_base 12: mod_base = OTHER; note = thymine
atccatatccttgactttgaaca

SEQ ID NO: 627 - RNA, 23 nt, synthetic construct
  source 1..23: mol_type = other RNA
  modified_base 2: mod_base = OTHER; note = thymine
  modified_base 7: mod_base = OTHER; note = thymine
  modified_base 12: mod_base = OTHER; note = thymine
attccatatccttgactttgaac

SEQ ID NO: 628 - RNA, 23 nt, synthetic construct
  source 1..23: mol_type = other RNA
  modified_base 2: mod_base = OTHER; note = thymine
atttccatatccttgactttgaa

SEQ ID NO: 629 - RNA, 23 nt, synthetic construct
  source 1..23: mol_type = other RNA
  modified_base 5: mod_base = OTHER; note = thymine
agactcagagactggctttcatc

SEQ ID NO: 630 - RNA, 23 nt, synthetic construct
  source 1..23: mol_type = other RNA
aagactcagagactggctttcat

SEQ ID NO: 631 - RNA, 23 nt, synthetic construct
  source 1..23: mol_type = other RNA
  modified_base 7: mod_base = OTHER; note = thymine
aaaccatgccacagagactcaga

SEQ ID NO: 632 - RNA, 23 nt, synthetic construct
  source 1..23: mol_type = other RNA
acccaaaccatgccacagagact

SEQ ID NO: 633 - RNA, 23 nt, synthetic construct
  source 1..23: mol_type = other RNA
  modified_base 2: mod_base = OTHER; note = thymine
  modified_base 5: mod_base = OTHER; note = thymine
atgttcccaaaccatgccacaga

SEQ ID NO: 634 - RNA, 23 nt, synthetic construct
  source 1..23: mol_type = other RNA
  modified_base 2: mod_base = OTHER; note = thymine
  modified_base 7: mod_base = OTHER; note = thymine
atgtgttcccaaaccatgccaca

SEQ ID NO: 635 - RNA, 23 nt, synthetic construct
  source 1..23: mol_type = other RNA
  modified_base 2: mod_base = OTHER; note = thymine
  modified_base 5: mod_base = OTHER; note = thymine
attgtggtaatcggtacccttcc

SEQ ID NO: 636 - RNA, 23 nt, synthetic construct
  source 1..23: mol_type = other RNA
  modified_base 5: mod_base = OTHER; note = thymine
  modified_base 7: mod_base = OTHER; note = thymine
agcttgtggtaatcggtaccctt

SEQ ID NO: 637 - RNA, 23 nt, synthetic construct
  source 1..23: mol_type = other RNA
  modified_base 7: mod_base = OTHER; note = thymine
agttgcttgtggtaatcggtacc

SEQ ID NO: 638 - RNA, 23 nt, synthetic construct
  source 1..23: mol_type = other RNA
  modified_base 2: mod_base = OTHER; note = thymine
  modified_base 5: mod_base = OTHER; note = thymine
  modified_base 12: mod_base = OTHER; note = thymine
atggttgcttgtggtaatcggta

SEQ ID NO: 639 - RNA, 23 nt, synthetic construct
  source 1..23: mol_type = other RNA
  modified_base 7: mod_base = OTHER; note = thymine
aatggttgcttgtggtaatcggt

SEQ ID NO: 640 - RNA, 23 nt, synthetic construct
  source 1..23: mol_type = other RNA
  modified_base 5: mod_base = OTHER; note = thymine
  modified_base 12: mod_base = OTHER; note = thymine
accatggttgcttgtggtaatcg

SEQ ID NO: 641 - RNA, 23 nt, synthetic construct
  source 1..23: mol_type = other RNA
agccatggttgcttgtggtaatc

SEQ ID NO: 642 - RNA, 23 nt, synthetic construct
  source 1..23: mol_type = other RNA
  modified_base 2: mod_base = OTHER; note = thymine
  modified_base 7: mod_base = OTHER; note = thymine
atgccatggttgcttgtggtaat

SEQ ID NO: 643 - RNA, 23 nt, synthetic construct
  source 1..23: mol_type = other RNA
  modified_base 12: mod_base = OTHER; note = thymine
actgccatggttgcttgtggtaa

SEQ ID NO: 644 - RNA, 23 nt, synthetic construct
  source 1..23: mol_type = other RNA
  modified_base 2: mod_base = OTHER; note = thymine
attggcctgccatggttgcttgt

SEQ ID NO: 645 - RNA, 23 nt, synthetic construct
  source 1..23: mol_type = other RNA
  modified_base 5: mod_base = OTHER; note = thymine
  modified_base 7: mod_base = OTHER; note = thymine
aagatcttggcctgccatggttg

SEQ ID NO: 646 - RNA, 23 nt, synthetic construct
  source 1..23: mol_type = other RNA
agagatcttggcctgccatggtt

SEQ ID NO: 647 - RNA, 23 nt, synthetic construct
  source 1..23: mol_type = other RNA
  modified_base 2: mod_base = OTHER; note = thymine
  modified_base 7: mod_base = OTHER; note = thymine
atgagatcttggcctgccatggt

SEQ ID NO: 648 - RNA, 23 nt, synthetic construct
  source 1..23: mol_type = other RNA
  modified_base 5: mod_base = OTHER; note = thymine
aaagtactcagacaccacagccc

SEQ ID NO: 649 - RNA, 23 nt, synthetic construct
  source 1..23: mol_type = other RNA
aaaagtactcagacaccacagcc

SEQ ID NO: 650 - RNA, 23 nt, synthetic construct
  source 1..23: mol_type = other RNA
  modified_base 7: mod_base = OTHER; note = thymine
acaaagtactcagacaccacagc

SEQ ID NO: 651 - RNA, 23 nt, synthetic construct
  source 1..23: mol_type = other RNA
aacaaagtactcagacaccacag

SEQ ID NO: 652 - RNA, 23 nt, synthetic construct
  source 1..23: mol_type = other RNA
  modified_base 12: mod_base = OTHER; note = thymine
acacaaagtactcagacaccaca

SEQ ID NO: 653 - RNA, 23 nt, synthetic construct
  source 1..23: mol_type = other RNA
aaaacaatgtgctgctgtcagca

SEQ ID NO: 654 - RNA, 23 nt, synthetic construct
  source 1..23: mol_type = other RNA
  modified_base 2: mod_base = OTHER; note = thymine
atctatctccaggtcccgcttct

SEQ ID NO: 655 - RNA, 23 nt, synthetic construct
  source 1..23: mol_type = other RNA
  modified_base 2: mod_base = OTHER; note = thymine
  modified_base 5: mod_base = OTHER; note = thymine
  modified_base 7: mod_base = OTHER; note = thymine
attctatctccaggtcccgcttc

SEQ ID NO: 656 - RNA, 23 nt, synthetic construct
  source 1..23: mol_type = other RNA
  modified_base 5: mod_base = OTHER; note = thymine
  modified_base 12: mod_base = OTHER; note = thymine
aaattcaggaattcctgcttctt

SEQ ID NO: 657 - RNA, 23 nt, synthetic construct
  source 1..23: mol_type = other RNA
  modified_base 5: mod_base = OTHER; note = thymine
aaaattcaggaattcctgcttct

SEQ ID NO: 658 - RNA, 23 nt, synthetic construct
  source 1..23: mol_type = other RNA
  modified_base 2: mod_base = OTHER; note = thymine
  modified_base 7: mod_base = OTHER; note = thymine
ataaaattcaggaattcctgctt

SEQ ID NO: 659 - RNA, 23 nt, synthetic construct
  source 1..23: mol_type = other RNA
aataaaattcaggaattcctgct

SEQ ID NO: 660 - RNA, 23 nt, synthetic construct
  source 1..23: mol_type = other RNA
acataaaattcaggaattcctgc

SEQ ID NO: 661 - RNA, 23 nt, synthetic construct
  source 1..23: mol_type = other RNA
  modified_base 2: mod_base = OTHER; note = thymine
  modified_base 5: mod_base = OTHER; note = thymine
atcataaaattcaggaattcctg

SEQ ID NO: 662 - RNA, 23 nt, synthetic construct
  source 1..23: mol_type = other RNA
  modified_base 12: mod_base = OTHER; note = thymine
agtcataaaattcaggaattcct

SEQ ID NO: 663 - RNA, 23 nt, synthetic construct
  source 1..23: mol_type = other RNA
  modified_base 7: mod_base = OTHER; note = thymine
  modified_base 12: mod_base = OTHER; note = thymine
aagtcataaaattcaggaattcc

SEQ ID NO: 664 - RNA, 23 nt, synthetic construct
  source 1..23: mol_type = other RNA
  modified_base 2: mod_base = OTHER; note = thymine
  modified_base 5: mod_base = OTHER; note = thymine
atagtcataaaattcaggaattc

SEQ ID NO: 665 - RNA, 23 nt, synthetic construct
  source 1..23: mol_type = other RNA
aatagtcataaaattcaggaatt

SEQ ID NO: 666 - RNA, 23 nt, synthetic construct
  source 1..23: mol_type = other RNA
  modified_base 7: mod_base = OTHER; note = thymine
acatagtcataaaattcaggaat

SEQ ID NO: 667 - RNA, 23 nt, synthetic construct
  source 1..23: mol_type = other RNA
  modified_base 2: mod_base = OTHER; note = thymine
  modified_base 5: mod_base = OTHER; note = thymine
atcatagtcataaaattcaggaa

SEQ ID NO: 668 - RNA, 23 nt, synthetic construct
  source 1..23: mol_type = other RNA
  modified_base 12: mod_base = OTHER; note = thymine
agtcatagtcataaaattcagga

SEQ ID NO: 669 - RNA, 23 nt, synthetic construct
  source 1..23: mol_type = other RNA
  modified_base 5: mod_base = OTHER; note = thymine
aacgtcatagtcataaaattcag

SEQ ID NO: 670 - RNA, 23 nt, synthetic construct
  source 1..23: mol_type = other RNA
  modified_base 12: mod_base = OTHER; note = thymine
aaacgtcatagtcataaaattca

SEQ ID NO: 671 - RNA, 23 nt, synthetic construct
  source 1..23: mol_type = other RNA
  modified_base 7: mod_base = OTHER; note = thymine
acaacgtcatagtcataaaattc

SEQ ID NO: 672 - RNA, 23 nt, synthetic construct
  source 1..23: mol_type = other RNA
  modified_base 12: mod_base = OTHER; note = thymine
aggcaacgtcatagtcataaaat

SEQ ID NO: 673 - RNA, 23 nt, synthetic construct
  source 1..23: mol_type = other RNA
agggcaacgtcatagtcataaaa

SEQ ID NO: 674 - RNA, 23 nt, synthetic construct
  source 1..23: mol_type = other RNA
aagggcaacgtcatagtcataaa

SEQ ID NO: 675 - RNA, 23 nt, synthetic construct
  source 1..23: mol_type = other RNA
  modified_base 12: mod_base = OTHER; note = thymine
acagggcaacgtcatagtcataa

SEQ ID NO: 676 - RNA, 23 nt, synthetic construct
  source 1..23: mol_type = other RNA
  modified_base 2: mod_base = OTHER; note = thymine
atcagggcaacgtcatagtcata

SEQ ID NO: 677 - RNA, 23 nt, synthetic construct
  source 1..23: mol_type = other RNA
aatcagggcaacgtcatagtcat

SEQ ID NO: 678 - RNA, 23 nt, synthetic construct
  source 1..23: mol_type = other RNA
  modified_base 7: mod_base = OTHER; note = thymine
acttgatcagggcaacgtcatag

SEQ ID NO: 679 - RNA, 23 nt, synthetic construct
  source 1..23: mol_type = other RNA
  modified_base 5: mod_base = OTHER; note = thymine
agcttgatcagggcaacgtcata

SEQ ID NO: 680 - RNA, 23 nt, synthetic construct
  source 1..23: mol_type = other RNA
  modified_base 5: mod_base = OTHER; note = thymine
aagcttgatcagggcaacgtcat

SEQ ID NO: 681 - RNA, 23 nt, synthetic construct
  source 1..23: mol_type = other RNA
  modified_base 7: mod_base = OTHER; note = thymine
agagcttgatcagggcaacgtca

SEQ ID NO: 682 - RNA, 23 nt, synthetic construct
  source 1..23: mol_type = other RNA
  modified_base 2: mod_base = OTHER; note = thymine
  modified_base 12: mod_base = OTHER; note = thymine
attgagcttgatcagggcaacgt

SEQ ID NO: 683 - RNA, 23 nt, synthetic construct
  source 1..23: mol_type = other RNA
acttgagcttgatcagggcaacg

SEQ ID NO: 684 - RNA, 23 nt, synthetic construct
  source 1..23: mol_type = other RNA
  modified_base 12: mod_base = OTHER; note = thymine
acaaatgggcctgatagtctggc

SEQ ID NO: 685 - RNA, 23 nt, synthetic construct
  source 1..23: mol_type = other RNA
  modified_base 7: mod_base = OTHER; note = thymine
aacaaatgggcctgatagtctgg

SEQ ID NO: 686 - RNA, 23 nt, synthetic construct
  source 1..23: mol_type = other RNA
agacaaatgggcctgatagtctg

SEQ ID NO: 687 - RNA, 23 nt, synthetic construct
  source 1..23: mol_type = other RNA
aagacaaatgggcctgatagtct

SEQ ID NO: 688 - RNA, 23 nt, synthetic construct
  source 1..23: mol_type = other RNA
agagacaaatgggcctgatagtc

SEQ ID NO: 689 - RNA, 23 nt, synthetic construct
  source 1..23: mol_type = other RNA
  modified_base 12: mod_base = OTHER; note = thymine
aaagctcgagttgttccctcggt

SEQ ID NO: 690 - RNA, 23 nt, synthetic construct
  source 1..23: mol_type = other RNA
  modified_base 7: mod_base = OTHER; note = thymine
  modified_base 12: mod_base = OTHER; note = thymine
aaaagctcgagttgttccctcgg

SEQ ID NO: 691 - RNA, 23 nt, synthetic construct
  source 1..23: mol_type = other RNA
acaaagctcgagttgttccctcg

SEQ ID NO: 692 - RNA, 23 nt, synthetic construct
  source 1..23: mol_type = other RNA
acctcaaagctcgagttgttccc

SEQ ID NO: 693 - RNA, 23 nt, synthetic construct
  source 1..23: mol_type = other RNA
  modified_base 5: mod_base = OTHER; note = thymine
  modified_base 12: mod_base = OTHER; note = thymine
agcctcaaagctcgagttgttcc

SEQ ID NO: 694 - RNA, 23 nt, synthetic construct
  source 1..23: mol_type = other RNA
  modified_base 7: mod_base = OTHER; note = thymine
aaagcctcaaagctcgagttgtt

SEQ ID NO: 695 - RNA, 23 nt, synthetic construct
  source 1..23: mol_type = other RNA
agaagcctcaaagctcgagttgt

SEQ ID NO: 696 - RNA, 23 nt, synthetic construct
  source 1..23: mol_type = other RNA
aggaagcctcaaagctcgagttg

SEQ ID NO: 697 - RNA, 23 nt, synthetic construct
  source 1..23: mol_type = other RNA
  modified_base 2: mod_base = OTHER; note = thymine
atggaggaagcctcaaagctcga

SEQ ID NO: 698 - RNA, 23 nt, synthetic construct
  source 1..23: mol_type = other RNA
  modified_base 2: mod_base = OTHER; note = thymine
attggaggaagcctcaaagctcg

SEQ ID NO: 699 - RNA, 23 nt, synthetic construct
  source 1..23: mol_type = other RNA
agttggaggaagcctcaaagctc

SEQ ID NO: 700 - RNA, 23 nt, synthetic construct
  source 1..23: mol_type = other RNA
  modified_base 5: mod_base = OTHER; note = thymine
aagttggaggaagcctcaaagct

SEQ ID NO: 701 - RNA, 23 nt, synthetic construct
  source 1..23: mol_type = other RNA
  modified_base 2: mod_base = OTHER; note = thymine
  modified_base 5: mod_base = OTHER; note = thymine
atagttggaggaagcctcaaagc

SEQ ID NO: 702 - RNA, 23 nt, synthetic construct
  source 1..23: mol_type = other RNA
  modified_base 2: mod_base = OTHER; note = thymine
  modified_base 5: mod_base = OTHER; note = thymine
atggtagttggaggaagcctcaa

SEQ ID NO: 703 - RNA, 23 nt, synthetic construct
  source 1..23: mol_type = other RNA
agtggtagttggaggaagcctca

SEQ ID NO: 704 - RNA, 23 nt, synthetic construct
  source 1..23: mol_type = other RNA
  modified_base 5: mod_base = OTHER; note = thymine
  modified_base 12: mod_base = OTHER; note = thymine
aaagtggtagttggaggaagcct

SEQ ID NO: 705 - RNA, 23 nt, synthetic construct
  source 1..23: mol_type = other RNA
  modified_base 7: mod_base = OTHER; note = thymine
agcaagtggtagttggaggaagc

SEQ ID NO: 706 - RNA, 23 nt, synthetic construct
  source 1..23: mol_type = other RNA
aggcaagtggtagttggaggaag

SEQ ID NO: 707 - RNA, 23 nt, synthetic construct
  source 1..23: mol_type = other RNA
  modified_base 2: mod_base = OTHER; note = thymine
attgctggcaagtggtagttgga

SEQ ID NO: 708 - RNA, 23 nt, synthetic construct
  source 1..23: mol_type = other RNA
  modified_base 2: mod_base = OTHER; note = thymine
  modified_base 5: mod_base = OTHER; note = thymine
atgttgctggcaagtggtagttg

SEQ ID NO: 709 - RNA, 23 nt, synthetic construct
  source 1..23: mol_type = other RNA
  modified_base 2: mod_base = OTHER; note = thymine
attgatatcctgtgcagggagca

SEQ ID NO: 710 - RNA, 23 nt, synthetic construct
  source 1..23: mol_type = other RNA
  modified_base 2: mod_base = OTHER; note = thymine
  modified_base 7: mod_base = OTHER; note = thymine
  modified_base 12: mod_base = OTHER; note = thymine
atttgatatcctgtgcagggagc

SEQ ID NO: 711 - RNA, 23 nt, synthetic construct
  source 1..23: mol_type = other RNA
  modified_base 5: mod_base = OTHER; note = thymine
actttgatatcctgtgcagggag

SEQ ID NO: 712 - RNA, 23 nt, synthetic construct
  source 1..23: mol_type = other RNA
  modified_base 5: mod_base = OTHER; note = thymine
  modified_base 7: mod_base = OTHER; note = thymine
  modified_base 12: mod_base = OTHER; note = thymine
aagctttgatatcctgtgcaggg

SEQ ID NO: 713 - RNA, 23 nt, synthetic construct
  source 1..23: mol_type = other RNA
  modified_base 12: mod_base = OTHER; note = thymine
aaacagagctttgatatcctgtg

SEQ ID NO: 714 - RNA, 23 nt, synthetic construct
  source 1..23: mol_type = other RNA
aacaaacagagctttgatatcct

SEQ ID NO: 715 - RNA, 23 nt, synthetic construct
  source 1..23: mol_type = other RNA
  modified_base 2: mod_base = OTHER; note = thymine
atcagacacaaacagagctttga

SEQ ID NO: 716 - RNA, 23 nt, synthetic construct
  source 1..23: mol_type = other RNA
  modified_base 7: mod_base = OTHER; note = thymine
aagacctccttccgagtcagctt

SEQ ID NO: 717 - RNA, 23 nt, synthetic construct
  source 1..23: mol_type = other RNA
  modified_base 2: mod_base = OTHER; note = thymine
  modified_base 12: mod_base = OTHER; note = thymine
atagacctccttccgagtcagct

SEQ ID NO: 718 - RNA, 23 nt, synthetic construct
  source 1..23: mol_type = other RNA
  modified_base 5: mod_base = OTHER; note = thymine
aatgtagacctccttccgagtca

SEQ ID NO: 719 - RNA, 23 nt, synthetic construct
  source 1..23: mol_type = other RNA
  modified_base 2: mod_base = OTHER; note = thymine
  modified_base 5: mod_base = OTHER; note = thymine
  modified_base 7: mod_base = OTHER; note = thymine
atgatgtagacctccttccgagt

SEQ ID NO: 720 - RNA, 23 nt, synthetic construct
  source 1..23: mol_type = other RNA
  modified_base 2: mod_base = OTHER; note = thymine
attgatgtagacctccttccgag

SEQ ID NO: 721 - RNA, 23 nt, synthetic construct
  source 1..23: mol_type = other RNA
  modified_base 2: mod_base = OTHER; note = thymine
  modified_base 5: mod_base = OTHER; note = thymine
attcttgatgtagacctccttcc

SEQ ID NO: 722 - RNA, 23 nt, synthetic construct
  source 1..23: mol_type = other RNA
  modified_base 7: mod_base = OTHER; note = thymine
  modified_base 12: mod_base = OTHER; note = thymine
aattcttgatgtagacctccttc

SEQ ID NO: 723 - RNA, 23 nt, synthetic construct
  source 1..23: mol_type = other RNA
  modified_base 5: mod_base = OTHER; note = thymine
  modified_base 12: mod_base = OTHER; note = thymine
actctcacagctgcctttcttat

SEQ ID NO: 724 - RNA, 23 nt, synthetic construct
  source 1..23: mol_type = other RNA
  modified_base 2: mod_base = OTHER; note = thymine
atctctctcacagctgcctttct

SEQ ID NO: 725 - RNA, 23 nt, synthetic construct
  source 1..23: mol_type = other RNA
  modified_base 2: mod_base = OTHER; note = thymine
  modified_base 12: mod_base = OTHER; note = thymine
atgagcatctctctcacagctgc

SEQ ID NO: 726 - RNA, 23 nt, synthetic construct
  source 1..23: mol_type = other RNA
  modified_base 12: mod_base = OTHER; note = thymine
aattgagcatctctctcacagct

SEQ ID NO: 727 - RNA, 23 nt, synthetic construct
  source 1..23: mol_type = other RNA
  modified_base 2: mod_base = OTHER; note = thymine
  modified_base 5: mod_base = OTHER; note = thymine
atattgagcatctctctcacagc

SEQ ID NO: 728 - RNA, 23 nt, synthetic construct
  source 1..23: mol_type = other RNA
  modified_base 5: mod_base = OTHER; note = thymine
  modified_base 12: mod_base = OTHER; note = thymine
aatattgagcatctctctcacag

SEQ ID NO: 729 - RNA, 23 nt, synthetic construct
  source 1..23: mol_type = other RNA
  modified_base 7: mod_base = OTHER; note = thymine
acatattgagcatctctctcaca

SEQ ID NO: 730 - RNA, 23 nt, synthetic construct
  source 1..23: mol_type = other RNA
  modified_base 5: mod_base = OTHER; note = thymine
  modified_base 7: mod_base = OTHER; note = thymine
agcatattgagcatctctctcac

SEQ ID NO: 731 - RNA, 23 nt, synthetic construct
  source 1..23: mol_type = other RNA
  modified_base 12: mod_base = OTHER; note = thymine
acttgactttgtcatagcctggg

SEQ ID NO: 732 - RNA, 23 nt, synthetic construct
  source 1..23: mol_type = other RNA
  modified_base 5: mod_base = OTHER; note = thymine
accttgactttgtcatagcctgg

SEQ ID NO: 733 - RNA, 23 nt, synthetic construct
  source 1..23: mol_type = other RNA
  modified_base 2: mod_base = OTHER; note = thymine
  modified_base 5: mod_base = OTHER; note = thymine
  modified_base 12: mod_base = OTHER; note = thymine
atccttgactttgtcatagcctg

SEQ ID NO: 734 - RNA, 23 nt, synthetic construct
  source 1..23: mol_type = other RNA
  modified_base 12: mod_base = OTHER; note = thymine
agagatgtccttgactttgtcat

SEQ ID NO: 735 - RNA, 23 nt, synthetic construct
  source 1..23: mol_type = other RNA
actccagtacaaaggaaccgagg

SEQ ID NO: 736 - RNA, 23 nt, synthetic construct
  source 1..23: mol_type = other RNA
acctccagtacaaaggaaccgag

SEQ ID NO: 737 - RNA, 23 nt, synthetic construct
  source 1..23: mol_type = other RNA
  modified_base 2: mod_base = OTHER; note = thymine
  modified_base 5: mod_base = OTHER; note = thymine
atcctccagtacaaaggaaccga

SEQ ID NO: 738 - RNA, 23 nt, synthetic construct
  source 1..23: mol_type = other RNA
  modified_base 7: mod_base = OTHER; note = thymine
  modified_base 12: mod_base = OTHER; note = thymine
aactcctccagtacaaaggaacc

SEQ ID NO: 739 - RNA, 23 nt, synthetic construct
  source 1..23: mol_type = other RNA
  modified_base 2: mod_base = OTHER; note = thymine
atcactcctccagtacaaaggaa

SEQ ID NO: 740 - RNA, 23 nt, synthetic construct
  source 1..23: mol_type = other RNA
  modified_base 5: mod_base = OTHER; note = thymine
  modified_base 12: mod_base = OTHER; note = thymine
agactcactcctccagtacaaag

SEQ ID NO: 741 - RNA, 23 nt, synthetic construct
  source 1..23: mol_type = other RNA
aggactcactcctccagtacaaa

SEQ ID NO: 742 - RNA, 23 nt, synthetic construct
  source 1..23: mol_type = other RNA
  modified_base 7: mod_base = OTHER; note = thymine
agggactcactcctccagtacaa

SEQ ID NO: 743 - RNA, 23 nt, synthetic construct
  source 1..23: mol_type = other RNA
  modified_base 2: mod_base = OTHER; note = thymine
atagggactcactcctccagtac

SEQ ID NO: 744 - RNA, 23 nt, synthetic construct
  source 1..23: mol_type = other RNA
acatagggactcactcctccagt

SEQ ID NO: 745 - RNA, 23 nt, synthetic construct
  source 1..23: mol_type = other RNA
aagcatagggactcactcctcca

SEQ ID NO: 746 - RNA, 23 nt, synthetic construct
  source 1..23: mol_type = other RNA
  modified_base 2: mod_base = OTHER; note = thymine
atcagcatagggactcactcctc

SEQ ID NO: 747 - RNA, 23 nt, synthetic construct
  source 1..23: mol_type = other RNA
agtcagcatagggactcactcct

SEQ ID NO: 748 - RNA, 23 nt, synthetic construct
  source 1..23: mol_type = other RNA
aaatcacctctgcaagtattggg

SEQ ID NO: 749 - RNA, 23 nt, synthetic construct
  source 1..23: mol_type = other RNA
  modified_base 5: mod_base = OTHER; note = thymine
  modified_base 12: mod_base = OTHER; note = thymine
agaatcacctctgcaagtattgg

SEQ ID NO: 750 - RNA, 23 nt, synthetic construct
  source 1..23: mol_type = other RNA
  modified_base 7: mod_base = OTHER; note = thymine
  modified_base 12: mod_base = OTHER; note = thymine
acagaatcacctctgcaagtatt

SEQ ID NO: 751 - RNA, 23 nt, synthetic construct
  source 1..23: mol_type = other RNA
agccagaatcacctctgcaagta

SEQ ID NO: 752 - RNA, 23 nt, synthetic construct
  source 1..23: mol_type = other RNA
acgccagaatcacctctgcaagt

SEQ ID NO: 753 - RNA, 23 nt, synthetic construct
  source 1..23: mol_type = other RNA
  modified_base 5: mod_base = OTHER; note = thymine
  modified_base 7: mod_base = OTHER; note = thymine
  modified_base 12: mod_base = OTHER; note = thymine
aacttctcttgtgaactatcaag

SEQ ID NO: 754 - RNA, 23 nt, synthetic construct
  source 1..23: mol_type = other RNA
  modified_base 5: mod_base = OTHER; note = thymine
agacttctcttgtgaactatcaa

SEQ ID NO: 755 - RNA, 23 nt, synthetic construct
  source 1..23: mol_type = other RNA
  modified_base 7: mod_base = OTHER; note = thymine
  modified_base 12: mod_base = OTHER; note = thymine
acgacttctcttgtgaactatca

SEQ ID NO: 756 - RNA, 23 nt, synthetic construct
  source 1..23: mol_type = other RNA
  modified_base 7: mod_base = OTHER; note = thymine
  modified_base 12: mod_base = OTHER; note = thymine
aacgacttctcttgtgaactatc

SEQ ID NO: 757 - RNA, 23 nt, synthetic construct
  source 1..23: mol_type = other RNA
aaacgacttctcttgtgaactat

SEQ ID NO: 758 - RNA, 23 nt, synthetic construct
  source 1..23: mol_type = other RNA
  modified_base 12: mod_base = OTHER; note = thymine
aaaacgacttctcttgtgaacta

SEQ ID NO: 759 - RNA, 23 nt, synthetic construct
  source 1..23: mol_type = other RNA
agaaacgacttctcttgtgaact

SEQ ID NO: 760 - RNA, 23 nt, synthetic construct
  source 1..23: mol_type = other RNA
  modified_base 2: mod_base = OTHER; note = thymine
  modified_base 12: mod_base = OTHER; note = thymine
atgaaacgacttctcttgtgaac

SEQ ID NO: 761 - RNA, 23 nt, synthetic construct
  source 1..23: mol_type = other RNA
  modified_base 12: mod_base = OTHER; note = thymine
aatgaaacgacttctcttgtgaa

SEQ ID NO: 762 - RNA, 23 nt, synthetic construct
  source 1..23: mol_type = other RNA
aaatgaaacgacttctcttgtga

SEQ ID NO: 763 - RNA, 23 nt, synthetic construct
  source 1..23: mol_type = other RNA
  modified_base 5: mod_base = OTHER; note = thymine
agaatgaaacgacttctcttgtg

SEQ ID NO: 764 - RNA, 23 nt, synthetic construct
  source 1..23: mol_type = other RNA
  modified_base 2: mod_base = OTHER; note = thymine
atgaatgaaacgacttctcttgt

SEQ ID NO: 765 - RNA, 23 nt, synthetic construct
  source 1..23: mol_type = other RNA
  modified_base 2: mod_base = OTHER; note = thymine
  modified_base 7: mod_base = OTHER; note = thymine
attgaatgaaacgacttctcttg

SEQ ID NO: 766 - RNA, 23 nt, synthetic construct
  source 1..23: mol_type = other RNA
acttgaatgaaacgacttctctt

SEQ ID NO: 767 - RNA, 23 nt, synthetic construct
  source 1..23: mol_type = other RNA
  modified_base 5: mod_base = OTHER; note = thymine
aacttgaatgaaacgacttctct

SEQ ID NO: 768 - RNA, 23 nt, synthetic construct
  source 1..23: mol_type = other RNA
  modified_base 5: mod_base = OTHER; note = thymine
aaacttgaatgaaacgacttctc

SEQ ID NO: 769 - RNA, 23 nt, synthetic construct
  source 1..23: mol_type = other RNA
  modified_base 7: mod_base = OTHER; note = thymine
acaacttgaatgaaacgacttct

SEQ ID NO: 770 - RNA, 23 nt, synthetic construct
  source 1..23: mol_type = other RNA
  modified_base 7: mod_base = OTHER; note = thymine
  modified_base 12: mod_base = OTHER; note = thymine
accaacttgaatgaaacgacttc

SEQ ID NO: 771 - RNA, 23 nt, synthetic construct
  source 1..23: mol_type = other RNA
  modified_base 2: mod_base = OTHER; note = thymine
  modified_base 12: mod_base = OTHER; note = thymine
atttgcagacatccactactccc

SEQ ID NO: 772 - RNA, 23 nt, synthetic construct
  source 1..23: mol_type = other RNA
  modified_base 2: mod_base = OTHER; note = thymine
  modified_base 5: mod_base = OTHER; note = thymine
attttgcagacatccactactcc

SEQ ID NO: 773 - RNA, 23 nt, synthetic construct
  source 1..23: mol_type = other RNA
  modified_base 2: mod_base = OTHER; note = thymine
  modified_base 5: mod_base = OTHER; note = thymine
atttttgcagacatccactactc

SEQ ID NO: 774 - RNA, 23 nt, synthetic construct
  source 1..23: mol_type = other RNA
  modified_base 5: mod_base = OTHER; note = thymine
  modified_base 7: mod_base = OTHER; note = thymine
agtttttgcagacatccactact

SEQ ID NO: 775 - RNA, 23 nt, synthetic construct
  source 1..23: mol_type = other RNA
  modified_base 5: mod_base = OTHER; note = thymine
  modified_base 7: mod_base = OTHER; note = thymine
aggtttttgcagacatccactac

SEQ ID NO: 776 - RNA, 23 nt, synthetic construct
  source 1..23: mol_type = other RNA
  modified_base 2: mod_base = OTHER; note = thymine
  modified_base 5: mod_base = OTHER; note = thymine
  modified_base 7: mod_base = OTHER; note = thymine
atggtttttgcagacatccacta

SEQ ID NO: 777 - RNA, 23 nt, synthetic construct
  source 1..23: mol_type = other RNA
  modified_base 7: mod_base = OTHER; note = thymine
actggtttttgcagacatccact

SEQ ID NO: 778 - RNA, 23 nt, synthetic construct
  source 1..23: mol_type = other RNA
  modified_base 2: mod_base = OTHER; note = thymine
  modified_base 7: mod_base = OTHER; note = thymine
atctggtttttgcagacatccac

SEQ ID NO: 779 - RNA, 23 nt, synthetic construct
  source 1..23: mol_type = other RNA
  modified_base 2: mod_base = OTHER; note = thymine
  modified_base 5: mod_base = OTHER; note = thymine
  modified_base 12: mod_base = OTHER; note = thymine
attctggtttttgcagacatcca

SEQ ID NO: 780 - RNA, 23 nt, synthetic construct
  source 1..23: mol_type = other RNA
  modified_base 5: mod_base = OTHER; note = thymine
  modified_base 12: mod_base = OTHER; note = thymine
acgcttctggtttttgcagacat

SEQ ID NO: 781 - RNA, 23 nt, synthetic construct
  source 1..23: mol_type = other RNA
  modified_base 7: mod_base = OTHER; note = thymine
  modified_base 12: mod_base = OTHER; note = thymine
accgcttctggtttttgcagaca

SEQ ID NO: 782 - RNA, 23 nt, synthetic construct
  source 1..23: mol_type = other RNA
  modified_base 7: mod_base = OTHER; note = thymine
agccgcttctggtttttgcagac

SEQ ID NO: 783 - RNA, 23 nt, synthetic construct
  source 1..23: mol_type = other RNA
  modified_base 2: mod_base = OTHER; note = thymine
atttgccgcttctggtttttgca

SEQ ID NO: 784 - RNA, 23 nt, synthetic construct
  source 1..23: mol_type = other RNA
  modified_base 2: mod_base = OTHER; note = thymine
  modified_base 5: mod_base = OTHER; note = thymine
  modified_base 12: mod_base = OTHER; note = thymine
attttgccgcttctggtttttgc

SEQ ID NO: 785 - RNA, 23 nt, synthetic construct
  source 1..23: mol_type = other RNA
  modified_base 5: mod_base = OTHER; note = thymine
  modified_base 12: mod_base = OTHER; note = thymine
acttttgccgcttctggtttttg

SEQ ID NO: 786 - RNA, 23 nt, synthetic construct
  source 1..23: mol_type = other RNA
  modified_base 5: mod_base = OTHER; note = thymine
  modified_base 7: mod_base = OTHER; note = thymine
agcttttgccgcttctggttttt

SEQ ID NO: 787 - RNA, 23 nt, synthetic construct
  source 1..23: mol_type = other RNA
  modified_base 2: mod_base = OTHER; note = thymine
  modified_base 5: mod_base = OTHER; note = thymine
  modified_base 7: mod_base = OTHER; note = thymine
atgcttttgccgcttctggtttt

SEQ ID NO: 788 - RNA, 23 nt, synthetic construct
  source 1..23: mol_type = other RNA
  modified_base 2: mod_base = OTHER; note = thymine
  modified_base 12: mod_base = OTHER; note = thymine
atacctgcttttgccgcttctgg

SEQ ID NO: 789 - RNA, 23 nt, synthetic construct
  source 1..23: mol_type = other RNA
  modified_base 12: mod_base = OTHER; note = thymine
acgtgagcaggtacctgcttttg

SEQ ID NO: 790 - RNA, 23 nt, synthetic construct
  source 1..23: mol_type = other RNA
  modified_base 2: mod_base = OTHER; note = thymine
attcagccagggcagcacttgaa

SEQ ID NO: 791 - RNA, 23 nt, synthetic construct
  source 1..23: mol_type = other RNA
  modified_base 2: mod_base = OTHER; note = thymine
  modified_base 7: mod_base = OTHER; note = thymine
atggagtttctccttcagccagg

SEQ ID NO: 792 - RNA, 23 nt, synthetic construct
  source 1..23: mol_type = other RNA
  modified_base 12: mod_base = OTHER; note = thymine
acaaatcctcatcttggagtttc

SEQ ID NO: 793 - RNA, 23 nt, synthetic construct
  source 1..23: mol_type = other RNA
  modified_base 12: mod_base = OTHER; note = thymine
aacccaaatcctcatcttggagt

SEQ ID NO: 794 - RNA, 23 nt, synthetic construct
  source 1..23: mol_type = other RNA
aaaacccaaatcctcatcttgga

SEQ ID NO: 795 - RNA, 23 nt, synthetic construct
  source 1..23: mol_type = other RNA
agaaaacccaaatcctcatcttg

SEQ ID NO: 796 - RNA, 23 nt, synthetic construct
  source 1..23: mol_type = other RNA
  modified_base 5: mod_base = OTHER; note = thymine
  modified_base 7: mod_base = OTHER; note = thymine
  modified_base 12: mod_base = OTHER; note = thymine
actgttttaattcaatcccacgc

SEQ ID NO: 797 - RNA, 23 nt, synthetic construct
  source 1..23: mol_type = other RNA
  modified_base 7: mod_base = OTHER; note = thymine
  modified_base 12: mod_base = OTHER; note = thymine
agctgttttaattcaatcccacg

SEQ ID NO: 798 - RNA, 23 nt, synthetic construct
  source 1..23: mol_type = other RNA
  modified_base 5: mod_base = OTHER; note = thymine
  modified_base 7: mod_base = OTHER; note = thymine
aagctgttttaattcaatcccac

SEQ ID NO: 799 - RNA, 23 nt, synthetic construct
  source 1..23: mol_type = other RNA
  modified_base 12: mod_base = OTHER; note = thymine
acgcagctgttttaattcaatcc

SEQ ID NO: 800 - RNA, 23 nt, synthetic construct
  source 1..23: mol_type = other RNA
  modified_base 2: mod_base = OTHER; note = thymine
  modified_base 12: mod_base = OTHER; note = thymine
atcgcagctgttttaattcaatc

SEQ ID NO: 801 - RNA, 23 nt, synthetic construct
  source 1..23: mol_type = other RNA
  modified_base 12: mod_base = OTHER; note = thymine
agtcgcagctgttttaattcaat

SEQ ID NO: 802 - RNA, 23 nt, synthetic construct
  source 1..23: mol_type = other RNA
  modified_base 2: mod_base = OTHER; note = thymine
atgtcgcagctgttttaattcaa

SEQ ID NO: 803 - RNA, 23 nt, synthetic construct
  source 1..23: mol_type = other RNA
aagggtacgggtagaagccagaa

SEQ ID NO: 804 - RNA, 23 nt, synthetic construct
  source 1..23: mol_type = other RNA
atcactcacattgtagtagggag

SEQ ID NO: 805 - RNA, 23 nt, synthetic construct
  source 1..23: mol_type = other RNA
aatcactcacattgtagtaggga

SEQ ID NO: 806 - RNA, 23 nt, synthetic construct
  source 1..23: mol_type = other RNA
aagatctcatcactcacattgta

SEQ ID NO: 807 - RNA, 23 nt, synthetic construct
  source 1..23: mol_type = other RNA
aagagatctcatcactcacattg

SEQ ID NO: 808 - RNA, 23 nt, synthetic construct
  source 1..23: mol_type = other RNA
agaaagagatctcatcactcaca

SEQ ID NO: 809 - RNA, 23 nt, synthetic construct
  source 1..23: mol_type = other RNA
atggaaagagatctcatcactca

SEQ ID NO: 810 - RNA, 23 nt, synthetic construct
  source 1..23: mol_type = other RNA
agtcatagcagtggaaagagatc

SEQ ID NO: 811 - RNA, 23 nt, synthetic construct
  source 1..23: mol_type = other RNA
aagtgtaaccgtcatagcagtgg

SEQ ID NO: 812 - RNA, 23 nt, synthetic construct
  source 1..23: mol_type = other RNA
attgtcacagatcgctgtctgcc

SEQ ID NO: 813 - RNA, 23 nt, synthetic construct
  source 1..23: mol_type = other RNA
ataggtgacgctgtcttcaaggc

SEQ ID NO: 814 - RNA, 23 nt, synthetic construct
  source 1..23: mol_type = other RNA
agtgtcgtacatgaaggagtctt

SEQ ID NO: 815 - RNA, 23 nt, synthetic construct
  source 1..23: mol_type = other RNA
acgactccttctatggtctctgt

SEQ ID NO: 816 - RNA, 23 nt, synthetic construct
  source 1..23: mol_type = other RNA
aatcgactccttctatggtctct

SEQ ID NO: 817 - RNA, 23 nt, synthetic construct
  source 1..23: mol_type = other RNA
acatcgactccttctatggtctc

SEQ ID NO: 818 - RNA, 23 nt, synthetic construct
  source 1..23: mol_type = other RNA
atagcaccaggtagatgttcatg

SEQ ID NO: 819 - RNA, 23 nt, synthetic construct
  source 1..23: mol_type = other RNA
agtctgatccatctagcaccagg

SEQ ID NO: 820 - RNA, 23 nt, synthetic construct
  source 1..23: mol_type = other RNA
actgtctgatccatctagcacca

SEQ ID NO: 821 - RNA, 23 nt, synthetic construct
  source 1..23: mol_type = other RNA
attttggctcctgtgaagttgct

SEQ ID NO: 822 - RNA, 23 nt, synthetic construct
  source 1..23: mol_type = other RNA
atttttggctcctgtgaagttgc

SEQ ID NO: 823 - RNA, 23 nt, synthetic construct
  source 1..23: mol_type = other RNA
aactttttggctcctgtgaagtt

SEQ ID NO: 824 - RNA, 23 nt, synthetic construct
  source 1..23: mol_type = other RNA
aactagacactttttggctcctg

SEQ ID NO: 825 - RNA, 23 nt, synthetic construct
  source 1..23: mol_type = other RNA
agactagacactttttggctcct

SEQ ID NO: 826 - RNA, 23 nt, synthetic construct
  source 1..23: mol_type = other RNA
attgactagacactttttggctc

SEQ ID NO: 827 - RNA, 23 nt, synthetic construct
  source 1..23: mol_type = other RNA
aagttgactagacactttttggc

SEQ ID NO: 828 - RNA, 23 nt, synthetic construct
  source 1..23: mol_type = other RNA
aaagttgactagacactttttgg

SEQ ID NO: 829 - RNA, 23 nt, synthetic construct
  source 1..23: mol_type = other RNA
ataagttgactagacactttttg

SEQ ID NO: 830 - RNA, 23 nt, synthetic construct
  source 1..23: mol_type = other RNA
attaagttgactagacacttttt

SEQ ID NO: 831 - RNA, 23 nt, synthetic construct
  source 1..23: mol_type = other RNA
actcaattaagttgactagacac

SEQ ID NO: 832 - RNA, 23 nt, synthetic construct
  source 1..23: mol_type = other RNA
aacttgccaccttctcaattaag

SEQ ID NO: 833 - RNA, 23 nt, synthetic construct
  source 1..23: mol_type = other RNA
aacaccataacttgccaccttct

SEQ ID NO: 834 - RNA, 23 nt, synthetic construct
  source 1..23: mol_type = other RNA
aggcttcacaccataacttgcca

SEQ ID NO: 835 - RNA, 23 nt, synthetic construct
  source 1..23: mol_type = other RNA
aatatcttggcttcacaccataa

SEQ ID NO: 836 - RNA, 23 nt, synthetic construct
  source 1..23: mol_type = other RNA
agacactttgacccaaattttgg

SEQ ID NO: 837 - RNA, 23 nt, synthetic construct
  source 1..23: mol_type = other RNA
atcagacactttgacccaaattt

SEQ ID NO: 838 - RNA, 23 nt, synthetic construct
  source 1..23: mol_type = other RNA
acgtgacccagtctgcattactg

SEQ ID NO: 839 - RNA, 23 nt, synthetic construct
  source 1..23: mol_type = other RNA
atcttcataattgatttcattga

SEQ ID NO: 840 - RNA, 23 nt, synthetic construct
  source 1..23: mol_type = other RNA
acttgtggtcttcataattgatt

SEQ ID NO: 841 - RNA, 23 nt, synthetic construct
  source 1..23: mol_type = other RNA
aacttgtggtcttcataattgat

SEQ ID NO: 842 - RNA, 23 nt, synthetic construct
  source 1..23: mol_type = other RNA
acaacttgtggtcttcataattg

SEQ ID NO: 843 - RNA, 23 nt, synthetic construct
  source 1..23: mol_type = other RNA
atcaacttgtggtcttcataatt

SEQ ID NO: 844 - RNA, 23 nt, synthetic construct
  source 1..23: mol_type = other RNA
attcaacttgtggtcttcataat

SEQ ID NO: 845 - RNA, 23 nt, synthetic construct
  source 1..23: mol_type = other RNA
acttcaacttgtggtcttcataa

SEQ ID NO: 846 - RNA, 23 nt, synthetic construct
  source 1..23: mol_type = other RNA
aacttcaacttgtggtcttcata

SEQ ID NO: 847 - RNA, 23 nt, synthetic construct
  source 1..23: mol_type = other RNA
agacttcaacttgtggtcttcat

SEQ ID NO: 848 - RNA, 23 nt, synthetic construct
  source 1..23: mol_type = other RNA
atgacttcaacttgtggtcttca

SEQ ID NO: 849 - RNA, 23 nt, synthetic construct
  source 1..23: mol_type = other RNA
agtccctgacttcaacttgtggt

SEQ ID NO: 850 - RNA, 23 nt, synthetic construct
  source 1..23: mol_type = other RNA
aagtccctgacttcaacttgtgg

SEQ ID NO: 851 - RNA, 23 nt, synthetic construct
  source 1..23: mol_type = other RNA
acatcatgctgtacactgcctgg

SEQ ID NO: 852 - RNA, 23 nt, synthetic construct
  source 1..23: mol_type = other RNA
actcatcatgctgtacactgcct

SEQ ID NO: 853 - RNA, 23 nt, synthetic construct
  source 1..23: mol_type = other RNA
agcccatgttgtgcaatccatca

SEQ ID NO: 854 - RNA, 23 nt, synthetic construct
  source 1..23: mol_type = other RNA
accgcccatgttgtgcaatccat

SEQ ID NO: 855 - RNA, 23 nt, synthetic construct
  source 1..23: mol_type = other RNA
atcaatgacagtaattgggtccc

SEQ ID NO: 856 - RNA, 23 nt, synthetic construct
  source 1..23: mol_type = other RNA
aatcaatgacagtaattgggtcc

SEQ ID NO: 857 - RNA, 23 nt, synthetic construct
  source 1..23: mol_type = other RNA
atcatcaatgacagtaattgggt

SEQ ID NO: 858 - RNA, 23 nt, synthetic construct
  source 1..23: mol_type = other RNA
aaagtcccggatctcatcaatga

SEQ ID NO: 859 - RNA, 23 nt, synthetic construct
  source 1..23: mol_type = other RNA
agtttttgcgatccttgccaatg

SEQ ID NO: 860 - RNA, 23 nt, synthetic construct
  source 1..23: mol_type = other RNA
aatccagataatcctcccttggg

SEQ ID NO: 861 - RNA, 23 nt, synthetic construct
  source 1..23: mol_type = other RNA
atagacatccagataatcctccc

SEQ ID NO: 862 - RNA, 23 nt, synthetic construct
  source 1..23: mol_type = other RNA
aacatagacatccagataatcct

SEQ ID NO: 863 - RNA, 23 nt, synthetic construct
  source 1..23: mol_type = other RNA
acacatagacatccagataatcc

SEQ ID NO: 864 - RNA, 23 nt, synthetic construct
  source 1..23: mol_type = other RNA
aacacatagacatccagataatc

SEQ ID NO: 865 - RNA, 23 nt, synthetic construct
  source 1..23: mol_type = other RNA
agcattgatgttcacttggttca

SEQ ID NO: 866 - RNA, 23 nt, synthetic construct
  source 1..23: mol_type = other RNA
aagcattgatgttcacttggttc

SEQ ID NO: 867 - RNA, 23 nt, synthetic construct
  source 1..23: mol_type = other RNA
aaagcattgatgttcacttggtt

SEQ ID NO: 868 - RNA, 23 nt, synthetic construct
  source 1..23: mol_type = other RNA
aaaagcattgatgttcacttggt

SEQ ID NO: 869 - RNA, 23 nt, synthetic construct
  source 1..23: mol_type = other RNA
attggaagccaaagcattgatgt

SEQ ID NO: 870 - RNA, 23 nt, synthetic construct
  source 1..23: mol_type = other RNA
atcttggaagccaaagcattgat

SEQ ID NO: 871 - RNA, 23 nt, synthetic construct
  source 1..23: mol_type = other RNA
aattgtctttcttggaagccaaa

SEQ ID NO: 872 - RNA, 23 nt, synthetic construct
  source 1..23: mol_type = other RNA
agctcattgtctttcttggaagc

SEQ ID NO: 873 - RNA, 23 nt, synthetic construct
  source 1..23: mol_type = other RNA
atgctcattgtctttcttggaag

SEQ ID NO: 874 - RNA, 23 nt, synthetic construct
  source 1..23: mol_type = other RNA
atgttgctcattgtctttcttgg

SEQ ID NO: 875 - RNA, 23 nt, synthetic construct
  source 1..23: mol_type = other RNA
aacatgttgctcattgtctttct

SEQ ID NO: 876 - RNA, 23 nt, synthetic construct
  source 1..23: mol_type = other RNA
aacacatgttgctcattgtcttt

SEQ ID NO: 877 - RNA, 23 nt, synthetic construct
  source 1..23: mol_type = other RNA
agaacacatgttgctcattgtct

SEQ ID NO: 878 - RNA, 23 nt, synthetic construct
  source 1..23: mol_type = other RNA
atgaacacatgttgctcattgtc

SEQ ID NO: 879 - RNA, 23 nt, synthetic construct
  source 1..23: mol_type = other RNA
atttgaacacatgttgctcattg

SEQ ID NO: 880 - RNA, 23 nt, synthetic construct
  source 1..23: mol_type = other RNA
aactttgaacacatgttgctcat

SEQ ID NO: 881 - RNA, 23 nt, synthetic construct
  source 1..23: mol_type = other RNA
attgactttgaacacatgttgct

SEQ ID NO: 882 - RNA, 23 nt, synthetic construct
  source 1..23: mol_type = other RNA
accttgactttgaacacatgttg

SEQ ID NO: 883 - RNA, 23 nt, synthetic construct
  source 1..23: mol_type = other RNA
aatccttgactttgaacacatgt

SEQ ID NO: 884 - RNA, 23 nt, synthetic construct
  source 1..23: mol_type = other RNA
atatccttgactttgaacacatg

SEQ ID NO: 885 - RNA, 23 nt, synthetic construct
  source 1..23: mol_type = other RNA
aatatccttgactttgaacacat

SEQ ID NO: 886 - RNA, 23 nt, synthetic construct
  source 1..23: mol_type = other RNA
atccatatccttgactttgaaca

SEQ ID NO: 887 - RNA, 23 nt, synthetic construct
  source 1..23: mol_type = other RNA
attccatatccttgactttgaac

SEQ ID NO: 888 - RNA, 23 nt, synthetic construct
  source 1..23: mol_type = other RNA
agttgcttgtggtaatcggtacc

SEQ ID NO: 889 - RNA, 23 nt, synthetic construct
  source 1..23: mol_type = other RNA
atggttgcttgtggtaatcggta

SEQ ID NO: 890 - RNA, 23 nt, synthetic construct
  source 1..23: mol_type = other RNA
accatggttgcttgtggtaatcg

SEQ ID NO: 891 - RNA, 23 nt, synthetic construct
  source 1..23: mol_type = other RNA
actgccatggttgcttgtggtaa

SEQ ID NO: 892 - RNA, 23 nt, synthetic construct
  source 1..23: mol_type = other RNA
acacaaagtactcagacaccaca

SEQ ID NO: 893 - RNA, 23 nt, synthetic construct
  source 1..23: mol_type = other RNA
aaattcaggaattcctgcttctt

SEQ ID NO: 894 - RNA, 23 nt, synthetic construct
  source 1..23: mol_type = other RNA
aaaattcaggaattcctgcttct

SEQ ID NO: 895 - RNA, 23 nt, synthetic construct
  source 1..23: mol_type = other RNA
ataaaattcaggaattcctgctt

SEQ ID NO: 896 - RNA, 23 nt, synthetic construct
  source 1..23: mol_type = other RNA
agtcataaaattcaggaattcct

SEQ ID NO: 897 - RNA, 23 nt, synthetic construct
  source 1..23: mol_type = other RNA
aagtcataaaattcaggaattcc

SEQ ID NO: 898 - RNA, 23 nt, synthetic construct
  source 1..23: mol_type = other RNA
atagtcataaaattcaggaattc

SEQ ID NO: 899 - RNA, 23 nt, synthetic construct
  source 1..23: mol_type = other RNA
atcatagtcataaaattcaggaa

SEQ ID NO: 900 - RNA, 23 nt, synthetic construct
  source 1..23: mol_type = other RNA
agtcatagtcataaaattcagga

SEQ ID NO: 901 - RNA, 23 nt, synthetic construct
  source 1..23: mol_type = other RNA
aacgtcatagtcataaaattcag

SEQ ID NO: 902 - RNA, 23 nt, synthetic construct
  source 1..23: mol_type = other RNA
aaacgtcatagtcataaaattca

SEQ ID NO: 903 - RNA, 23 nt, synthetic construct
  source 1..23: mol_type = other RNA
acaacgtcatagtcataaaattc

SEQ ID NO: 904 - RNA, 23 nt, synthetic construct
  source 1..23: mol_type = other RNA
aggcaacgtcatagtcataaaat

SEQ ID NO: 905 - RNA, 23 nt, synthetic construct
  source 1..23: mol_type = other RNA
acagggcaacgtcatagtcataa

SEQ ID NO: 906 - RNA, 23 nt, synthetic construct
  source 1..23: mol_type = other RNA
acaaatgggcctgatagtctggc

SEQ ID NO: 907 - RNA, 23 nt, synthetic construct
  source 1..23: mol_type = other RNA
aacaaatgggcctgatagtctgg

SEQ ID NO: 908 - RNA, 23 nt, synthetic construct
  source 1..23: mol_type = other RNA
aaagctcgagttgttccctcggt

SEQ ID NO: 909 - RNA, 23 nt, synthetic construct
  source 1..23: mol_type = other RNA
aaaagctcgagttgttccctcgg

SEQ ID NO: 910 - RNA, 23 nt, synthetic construct
  source 1..23: mol_type = other RNA
agcctcaaagctcgagttgttcc

SEQ ID NO: 911 - RNA, 23 nt, synthetic construct
  source 1..23: mol_type = other RNA
aaagtggtagttggaggaagcct

SEQ ID NO: 912 - RNA, 23 nt, synthetic construct
  source 1..23: mol_type = other RNA
aagctttgatatcctgtgcaggg

SEQ ID NO: 913 - RNA, 23 nt, synthetic construct
  source 1..23: mol_type = other RNA
aaacagagctttgatatcctgtg

SEQ ID NO: 914 - RNA, 23 nt, synthetic construct
  source 1..23: mol_type = other RNA
atcagacacaaacagagctttga

SEQ ID NO: 915 - RNA, 23 nt, synthetic construct
  source 1..23: mol_type = other RNA
actctcacagctgcctttcttat

SEQ ID NO: 916 - RNA, 23 nt, synthetic construct
  source 1..23: mol_type = other RNA
atgagcatctctctcacagctgc

SEQ ID NO: 917 - RNA, 23 nt, synthetic construct
  source 1..23: mol_type = other RNA
aattgagcatctctctcacagct

SEQ ID NO: 918 - RNA, 23 nt, synthetic construct
  source 1..23: mol_type = other RNA
atattgagcatctctctcacagc

SEQ ID NO: 919 - RNA, 23 nt, synthetic construct
  source 1..23: mol_type = other RNA
aatattgagcatctctctcacag

SEQ ID NO: 920 - RNA, 23 nt, synthetic construct
  source 1..23: mol_type = other RNA
acatattgagcatctctctcaca

SEQ ID NO: 921 - RNA, 23 nt, synthetic construct
  source 1..23: mol_type = other RNA
agcatattgagcatctctctcac

SEQ ID NO: 922 - RNA, 23 nt, synthetic construct
  source 1..23: mol_type = other RNA
acttgactttgtcatagcctggg

SEQ ID NO: 923 - RNA, 23 nt, synthetic construct
  source 1..23: mol_type = other RNA
atccttgactttgtcatagcctg

SEQ ID NO: 924 - RNA, 23 nt, synthetic construct
  source 1..23: mol_type = other RNA
agagatgtccttgactttgtcat

SEQ ID NO: 925 - RNA, 23 nt, synthetic construct
  source 1..23: mol_type = other RNA
agactcactcctccagtacaaag

SEQ ID NO: 926 - RNA, 23 nt, synthetic construct
  source 1..23: mol_type = other RNA
agaatcacctctgcaagtattgg

SEQ ID NO: 927 - RNA, 23 nt, synthetic construct
  source 1..23: mol_type = other RNA
acagaatcacctctgcaagtatt

SEQ ID NO: 928 - RNA, 23 nt, synthetic construct
  source 1..23: mol_type = other RNA
aacttctcttgtgaactatcaag

SEQ ID NO: 929 - RNA, 23 nt, synthetic construct
  source 1..23: mol_type = other RNA
agacttctcttgtgaactatcaa

SEQ ID NO: 930 - RNA, 23 nt, synthetic construct
  source 1..23: mol_type = other RNA
acgacttctcttgtgaactatca

SEQ ID NO: 931 - RNA, 23 nt, synthetic construct
  source 1..23: mol_type = other RNA
aacgacttctcttgtgaactatc

SEQ ID NO: 932 - RNA, 23 nt, synthetic construct
  source 1..23: mol_type = other RNA
aaaacgacttctcttgtgaacta

SEQ ID NO: 933 - RNA, 23 nt, synthetic construct
  source 1..23: mol_type = other RNA
atgaaacgacttctcttgtgaac

SEQ ID NO: 934 - RNA, 23 nt, synthetic construct
  source 1..23: mol_type = other RNA
aatgaaacgacttctcttgtgaa

SEQ ID NO: 935 - RNA, 23 nt, synthetic construct
  source 1..23: mol_type = other RNA
agaatgaaacgacttctcttgtg

SEQ ID NO: 936 - RNA, 23 nt, synthetic construct
  source 1..23: mol_type = other RNA
atgaatgaaacgacttctcttgt

SEQ ID NO: 937 - RNA, 23 nt, synthetic construct
  source 1..23: mol_type = other RNA
aacttgaatgaaacgacttctct

SEQ ID NO: 938 - RNA, 23 nt, synthetic construct
  source 1..23: mol_type = other RNA
aaacttgaatgaaacgacttctc

SEQ ID NO: 939 - RNA, 23 nt, synthetic construct
  source 1..23: mol_type = other RNA
acaacttgaatgaaacgacttct

SEQ ID NO: 940 - RNA, 23 nt, synthetic construct
  source 1..23: mol_type = other RNA
accaacttgaatgaaacgacttc

SEQ ID NO: 941 - RNA, 23 nt, synthetic construct
  source 1..23: mol_type = other RNA
atttgcagacatccactactccc

SEQ ID NO: 942 - RNA, 23 nt, synthetic construct
  source 1..23: mol_type = other RNA
attttgcagacatccactactcc

SEQ ID NO: 943 - RNA, 23 nt, synthetic construct
  source 1..23: mol_type = other RNA
atttttgcagacatccactactc

SEQ ID NO: 944 - RNA, 23 nt, synthetic construct
  source 1..23: mol_type = other RNA
agtttttgcagacatccactact

SEQ ID NO: 945 - RNA, 23 nt, synthetic construct
  source 1..23: mol_type = other RNA
atctggtttttgcagacatccac

SEQ ID NO: 946 - RNA, 23 nt, synthetic construct
  source 1..23: mol_type = other RNA
attctggtttttgcagacatcca

SEQ ID NO: 947 - RNA, 23 nt, synthetic construct
  source 1..23: mol_type = other RNA
acgcttctggtttttgcagacat

SEQ ID NO: 948 - RNA, 23 nt, synthetic construct
  source 1..23: mol_type = other RNA
accgcttctggtttttgcagaca

SEQ ID NO: 949 - RNA, 23 nt, synthetic construct
  source 1..23: mol_type = other RNA
attttgccgcttctggtttttgc

SEQ ID NO: 950 - RNA, 23 nt, synthetic construct
  source 1..23: mol_type = other RNA
acttttgccgcttctggtttttg

SEQ ID NO: 951 - RNA, 23 nt, synthetic construct
  source 1..23: mol_type = other RNA
atgcttttgccgcttctggtttt

SEQ ID NO: 952 - RNA, 23 nt, synthetic construct
  source 1..23: mol_type = other RNA
atacctgcttttgccgcttctgg

SEQ ID NO: 953 - RNA, 23 nt, synthetic construct
  source 1..23: mol_type = other RNA
acaaatcctcatcttggagtttc

SEQ ID NO: 954 - RNA, 23 nt, synthetic construct
  source 1..23: mol_type = other RNA
aacccaaatcctcatcttggagt

SEQ ID NO: 955 - RNA, 23 nt, synthetic construct
  source 1..23: mol_type = other RNA
actgttttaattcaatcccacgc

SEQ ID NO: 956 - RNA, 23 nt, synthetic construct
  source 1..23: mol_type = other RNA
agctgttttaattcaatcccacg

SEQ ID NO: 957 - RNA, 23 nt, synthetic construct
  source 1..23: mol_type = other RNA
aagctgttttaattcaatcccac

SEQ ID NO: 958 - RNA, 23 nt, synthetic construct
  source 1..23: mol_type = other RNA
acgcagctgttttaattcaatcc

SEQ ID NO: 959 - RNA, 23 nt, synthetic construct
  source 1..23: mol_type = other RNA
atgtccaagctgaaactccagac

SEQ ID NO: 960 - RNA, 23 nt, synthetic construct
  source 1..23: mol_type = other RNA
atctgcacagggtacgggtagaa

SEQ ID NO: 961 - RNA, 23 nt, synthetic construct
  source 1..23: mol_type = other RNA
atctgcaggtacgtgtctgcaca

SEQ ID NO: 962 - RNA, 23 nt, synthetic construct
  source 1..23: mol_type = other RNA
  modified_base 7: mod_base = OTHER; note = thymine
aatcactcacattgtagtaggga

SEQ ID NO: 963 - RNA, 23 nt, synthetic construct
  source 1..23: mol_type = other RNA
  modified_base 7: mod_base = OTHER; note = thymine
aagagatctcatcactcacattg

SEQ ID NO: 964 - RNA, 23 nt, synthetic construct
  source 1..23: mol_type = other RNA
  modified_base 5: mod_base = OTHER; note = thymine
attgtcacagatcgctgtctgcc

SEQ ID NO: 965 - RNA, 23 nt, synthetic construct
  source 1..23: mol_type = other RNA
atgcccaccttccttgtgccaat

SEQ ID NO: 966 - RNA, 23 nt, synthetic construct
  source 1..23: mol_type = other RNA
  modified_base 7: mod_base = OTHER; note = thymine
atgtcgtacatgaaggagtcttg

SEQ ID NO: 967 - RNA, 23 nt, synthetic construct
  source 1..23: mol_type = other RNA
  modified_base 7: mod_base = OTHER; note = thymine
atcgactccttctatggtctctg

SEQ ID NO: 968 - RNA, 23 nt, synthetic construct
  source 1..23: mol_type = other RNA
  modified_base 5: mod_base = OTHER; note = thymine
agtctgatccatctagcaccagg

SEQ ID NO: 969 - RNA, 23 nt, synthetic construct
  source 1..23: mol_type = other RNA
atagacactttttggctcctgtg

SEQ ID NO: 970 - RNA, 23 nt, synthetic construct
  source 1..23: mol_type = other RNA
atgactagacactttttggctcc

SEQ ID NO: 971 - RNA, 23 nt, synthetic construct
  source 1..23: mol_type = other RNA
  modified_base 7: mod_base = OTHER; note = thymine
attgactagacactttttggctc

SEQ ID NO: 972 - RNA, 23 nt, synthetic construct
  source 1..23: mol_type = other RNA
  modified_base 7: mod_base = OTHER; note = thymine
ataagttgactagacactttttg

SEQ ID NO: 973 - RNA, 23 nt, synthetic construct
  source 1..23: mol_type = other RNA
  modified_base 7: mod_base = OTHER; note = thymine
attaagttgactagacacttttt

SEQ ID NO: 974 - RNA, 23 nt, synthetic construct
  source 1..23: mol_type = other RNA
  modified_base 5: mod_base = OTHER; note = thymine
  modified_base 7: mod_base = OTHER; note = thymine
accttctcaattaagttgactag

SEQ ID NO: 975 - RNA, 23 nt, synthetic construct
  source 1..23: mol_type = other RNA
  modified_base 5: mod_base = OTHER; note = thymine
  modified_base 7: mod_base = OTHER; note = thymine
aatatcttggcttcacaccataa

SEQ ID NO: 976 - RNA, 23 nt, synthetic construct
  source 1..23: mol_type = other RNA
  modified_base 5: mod_base = OTHER; note = thymine
atcgtgacccagtctgcattact

SEQ ID NO: 977 - RNA, 23 nt, synthetic construct
  source 1..23: mol_type = other RNA
  modified_base 5: mod_base = OTHER; note = thymine
atcttcataattgatttcattga

SEQ ID NO: 978 - RNA, 23 nt, synthetic construct
  source 1..23: mol_type = other RNA
  modified_base 7: mod_base = OTHER; note = thymine
atgtggtcttcataattgatttc

SEQ ID NO: 979 - RNA, 23 nt, synthetic construct
  source 1..23: mol_type = other RNA
  modified_base 5: mod_base = OTHER; note = thymine
  modified_base 7: mod_base = OTHER; note = thymine
aacttgtggtcttcataattgat

SEQ ID NO: 980 - RNA, 23 nt, synthetic construct
  source 1..23: mol_type = other RNA
  modified_base 7: mod_base = OTHER; note = thymine
atcaacttgtggtcttcataatt

SEQ ID NO: 981 - RNA, 23 nt, synthetic construct
  source 1..23: mol_type = other RNA
  modified_base 7: mod_base = OTHER; note = thymine
atgacttcaacttgtggtcttca

SEQ ID NO: 982 - RNA, 23 nt, synthetic construct
  source 1..23: mol_type = other RNA
  modified_base 7: mod_base = OTHER; note = thymine
agtccctgacttcaacttgtggt

SEQ ID NO: 983 - RNA, 23 nt, synthetic construct
  source 1..23: mol_type = other RNA
  modified_base 5: mod_base = OTHER; note = thymine
  modified_base 7: mod_base = OTHER; note = thymine
agtttttgcgatccttgccaatg

SEQ ID NO: 984 - RNA, 23 nt, synthetic construct
  source 1..23: mol_type = other RNA
  modified_base 7: mod_base = OTHER; note = thymine
agctcattgtctttcttggaagc

SEQ ID NO: 985 - RNA, 23 nt, synthetic construct
  source 1..23: mol_type = other RNA
  modified_base 5: mod_base = OTHER; note = thymine
atgctcattgtctttcttggaag

SEQ ID NO: 986 - RNA, 23 nt, synthetic construct
  source 1..23: mol_type = other RNA
  modified_base 7: mod_base = OTHER; note = thymine
attgactttgaacacatgttgct

SEQ ID NO: 987 - RNA, 23 nt, synthetic construct
  source 1..23: mol_type = other RNA
  modified_base 7: mod_base = OTHER; note = thymine
aatccttgactttgaacacatgt

SEQ ID NO: 988 - RNA, 23 nt, synthetic construct
  source 1..23: mol_type = other RNA
  modified_base 7: mod_base = OTHER; note = thymine
atatccttgactttgaacacatg

SEQ ID NO: 989 - RNA, 23 nt, synthetic construct
  source 1..23: mol_type = other RNA
  modified_base 7: mod_base = OTHER; note = thymine
attccatatccttgactttgaac

SEQ ID NO: 990 - RNA, 23 nt, synthetic construct
  source 1..23: mol_type = other RNA
atttccatatccttgactttgaa

SEQ ID NO: 991 - RNA, 23 nt, synthetic construct
  source 1..23: mol_type = other RNA
  modified_base 7: mod_base = OTHER; note = thymine
atgtgttcccaaaccatgccaca

SEQ ID NO: 992 - RNA, 23 nt, synthetic construct
  source 1..23: mol_type = other RNA
  modified_base 7: mod_base = OTHER; note = thymine
atgccatggttgcttgtggtaat

SEQ ID NO: 993 - RNA, 23 nt, synthetic construct
  source 1..23: mol_type = other RNA
  modified_base 7: mod_base = OTHER; note = thymine
atgagatcttggcctgccatggt

SEQ ID NO: 994 - RNA, 23 nt, synthetic construct
  source 1..23: mol_type = other RNA
  modified_base 5: mod_base = OTHER; note = thymine
  modified_base 7: mod_base = OTHER; note = thymine
attctatctccaggtcccgcttc

SEQ ID NO: 995 - RNA, 23 nt, synthetic construct
  source 1..23: mol_type = other RNA
  modified_base 5: mod_base = OTHER; note = thymine
aaattcaggaattcctgcttctt

SEQ ID NO: 996 - RNA, 23 nt, synthetic construct
  source 1..23: mol_type = other RNA
  modified_base 7: mod_base = OTHER; note = thymine
aagtcataaaattcaggaattcc

SEQ ID NO: 997 - RNA, 23 nt, synthetic construct
  source 1..23: mol_type = other RNA
  modified_base 5: mod_base = OTHER; note = thymine
atagtcataaaattcaggaattc

SEQ ID NO: 998 - RNA, 23 nt, synthetic construct
  source 1..23: mol_type = other RNA
  modified_base 7: mod_base = OTHER; note = thymine
aaaagctcgagttgttccctcgg

SEQ ID NO: 999 - RNA, 23 nt, synthetic construct
  source 1..23: mol_type = other RNA
attgatatcctgtgcagggagca

SEQ ID NO: 1000 - RNA, 23 nt, synthetic construct
  source 1..23: mol_type = other RNA
  modified_base 7: mod_base = OTHER; note = thymine
atttgatatcctgtgcagggagc

SEQ ID NO: 1001 - RNA, 23 nt, synthetic construct
  source 1..23: mol_type = other RNA
  modified_base 5: mod_base = OTHER; note = thymine
  modified_base 7: mod_base = OTHER; note = thymine
aagctttgatatcctgtgcaggg

SEQ ID NO: 1002 - RNA, 23 nt, synthetic construct
  source 1..23: mol_type = other RNA
  modified_base 5: mod_base = OTHER; note = thymine
  modified_base 7: mod_base = OTHER; note = thymine
atgatgtagacctccttccgagt

SEQ ID NO: 1003 - RNA, 23 nt, synthetic construct
  source 1..23: mol_type = other RNA
  modified_base 7: mod_base = OTHER; note = thymine
aattcttgatgtagacctccttc

SEQ ID NO: 1004 - RNA, 23 nt, synthetic construct
  source 1..23: mol_type = other RNA
  modified_base 5: mod_base = OTHER; note = thymine
actctcacagctgcctttcttat

SEQ ID NO: 1005 - RNA, 23 nt, synthetic construct
  source 1..23: mol_type = other RNA
  modified_base 5: mod_base = OTHER; note = thymine
atattgagcatctctctcacagc

SEQ ID NO: 1006 - RNA, 23 nt, synthetic construct
  source 1..23: mol_type = other RNA
  modified_base 7: mod_base = OTHER; note = thymine
aactcctccagtacaaaggaacc

SEQ ID NO: 1007 - RNA, 23 nt, synthetic construct
  source 1..23: mol_type = other RNA
  modified_base 5: mod_base = OTHER; note = thymine
agactcactcctccagtacaaag

SEQ ID NO: 1008 - RNA, 23 nt, synthetic construct
  source 1..23: mol_type = other RNA
atagggactcactcctccagtac

SEQ ID NO: 1009 - RNA, 23 nt, synthetic construct
  source 1..23: mol_type = other RNA
atcagcatagggactcactcctc

SEQ ID NO: 1010 - RNA, 23 nt, synthetic construct
  source 1..23: mol_type = other RNA
  modified_base 5: mod_base = OTHER; note = thymine
agaatcacctctgcaagtattgg

SEQ ID NO: 1011 - RNA, 23 nt, synthetic construct
  source 1..23: mol_type = other RNA
  modified_base 5: mod_base = OTHER; note = thymine
  modified_base 7: mod_base = OTHER; note = thymine
aacttctcttgtgaactatcaag

SEQ ID NO: 1012 - RNA, 23 nt, synthetic construct
  source 1..23: mol_type = other RNA
  modified_base 5: mod_base = OTHER; note = thymine
  modified_base 7: mod_base = OTHER; note = thymine
atggtttttgcagacatccacta

SEQ ID NO: 1013 - RNA, 23 nt, synthetic construct
  source 1..23: mol_type = other RNA
  modified_base 7: mod_base = OTHER; note = thymine
atctggtttttgcagacatccac

SEQ ID NO: 1014 - RNA, 23 nt, synthetic construct
  source 1..23: mol_type = other RNA
  modified_base 5: mod_base = OTHER; note = thymine
  modified_base 7: mod_base = OTHER; note = thymine
atgcttttgccgcttctggtttt

SEQ ID NO: 1015 - RNA, 23 nt, synthetic construct
  source 1..23: mol_type = other RNA
  modified_base 7: mod_base = OTHER; note = thymine
atggagtttctccttcagccagg

SEQ ID NO: 1016 - RNA, 23 nt, synthetic construct
  source 1..23: mol_type = other RNA
  modified_base 7: mod_base = OTHER; note = thymine
agctgttttaattcaatcccacg

SEQ ID NO: 1017 - RNA, 23 nt, synthetic construct
  source 1..23: mol_type = other RNA
agtcgcagctgttttaattcaat

SEQ ID NO: 1018 - RNA, 23 nt, synthetic construct
  source 1..23: mol_type = other RNA
attgtcgcagctgttttaattca

SEQ ID NO: 1019 - RNA, 23 nt, synthetic construct
  source 1..23: mol_type = other RNA
  modified_base 2: mod_base = OTHER; note = thymine
  modified_base 5: mod_base = OTHER; note = thymine
  modified_base 12: mod_base = OTHER; note = thymine
attgtcgcagctgttttaattca

SEQ ID NO: 1020 - RNA, 23 nt, synthetic construct
  source 1..23: mol_type = other RNA
agttgtcgcagctgttttaattc

SEQ ID NO: 1021 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagggaatgtgaccaggtctt

SEQ ID NO: 1022 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agggaatgtgaccaggtctat

SEQ ID NO: 1023 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gggaatgtgaccaggtctagt

SEQ ID NO: 1024 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggaatgtgaccaggtctaggt

SEQ ID NO: 1025 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgtgaccaggtctaggtctgt

SEQ ID NO: 1026 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgaccaggtctaggtctggt

SEQ ID NO: 1027 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aggtctaggtctggagtttct

SEQ ID NO: 1028 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtctggagtttcagcttggat

SEQ ID NO: 1029 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tctggagtttcagcttggact

SEQ ID NO: 1030 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctggagtttcagcttggacat

SEQ ID NO: 1031 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tccttccgacttctccaagat

SEQ ID NO: 1032 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgtccttctggcttctaccct

SEQ ID NO: 1033 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tccttctggcttctacccgtt

SEQ ID NO: 1034 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccttctggcttctacccgtat

SEQ ID NO: 1035 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cttctggcttctacccgtact

SEQ ID NO: 1036 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctggcttctacccgtaccctt

SEQ ID NO: 1037 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctacccgtaccctgtgcagat

SEQ ID NO: 1038 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgcagacacgtacctgcagat

SEQ ID NO: 1039 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaggcagagtgcagagcaatt

SEQ ID NO: 1040 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggcagagtgcagagcaatcct

SEQ ID NO: 1041 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cggtctccctactacaatgtt

SEQ ID NO: 1042 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccctactacaatgtgagtgat

SEQ ID NO: 1043 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cctactacaatgtgagtgatt

SEQ ID NO: 1044 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctactacaatgtgagtgatgt

SEQ ID NO: 1045 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
actacaatgtgagtgatgagt

SEQ ID NO: 1046 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acaatgtgagtgatgagatct

SEQ ID NO: 1047 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caatgtgagtgatgagatctt

SEQ ID NO: 1048 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aatgtgagtgatgagatctct

SEQ ID NO: 1049 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgtgagtgatgagatctctt

SEQ ID NO: 1050 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgtgagtgatgagatctcttt

SEQ ID NO: 1051 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgagtgatgagatctctttt

SEQ ID NO: 1052 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgagtgatgagatctctttct

SEQ ID NO: 1053 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gagtgatgagatctctttcct

SEQ ID NO: 1054 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agtgatgagatctctttccat

SEQ ID NO: 1055 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgatgagatctctttccact

SEQ ID NO: 1056 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgatgagatctctttccactt

SEQ ID NO: 1057 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gatctctttccactgctatgt

SEQ ID NO: 1058 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atctctttccactgctatgat

SEQ ID NO: 1059 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tctctttccactgctatgact

SEQ ID NO: 1060 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctctttccactgctatgacgt

SEQ ID NO: 1061 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tctttccactgctatgacggt

SEQ ID NO: 1062 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
actgctatgacggttacactt

SEQ ID NO: 1063 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctgctatgacggttacactct

SEQ ID NO: 1064 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tatgacggttacactctccgt

SEQ ID NO: 1065 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgacggttacactctccggt

SEQ ID NO: 1066 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atcgcacctgccaagtgaatt

SEQ ID NO: 1067 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcgcacctgccaagtgaatgt

SEQ ID NO: 1068 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cgcacctgccaagtgaatggt

SEQ ID NO: 1069 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cagacagcgatctgtgacaat

SEQ ID NO: 1070 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agacagcgatctgtgacaact

SEQ ID NO: 1071 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gacagcgatctgtgacaacgt

SEQ ID NO: 1072 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acagcgatctgtgacaacggt

SEQ ID NO: 1073 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cagcgatctgtgacaacggat

SEQ ID NO: 1074 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agcgatctgtgacaacggagt

SEQ ID NO: 1075 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggcacaaggaaggtgggcat

SEQ ID NO: 1076 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccgccttgaagacagcgtcat

SEQ ID NO: 1077 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cttgaagacagcgtcacctat

SEQ ID NO: 1078 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttgaagacagcgtcacctact

SEQ ID NO: 1079 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgaagacagcgtcacctacct

SEQ ID NO: 1080 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgtcaggaaggtggctcttt

SEQ ID NO: 1081 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccttcctgccaagactccttt

SEQ ID NO: 1082 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcctgccaagactccttcatt

SEQ ID NO: 1083 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctgccaagactccttcatgtt

SEQ ID NO: 1084 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgccaagactccttcatgtat

SEQ ID NO: 1085 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caagactccttcatgtacgat

SEQ ID NO: 1086 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagactccttcatgtacgact

SEQ ID NO: 1087 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agactccttcatgtacgacat

SEQ ID NO: 1088 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gactccttcatgtacgacact

SEQ ID NO: 1089 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caagaggtggccgaagctttt

SEQ ID NO: 1090 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gccgaagctttcctgtcttct

SEQ ID NO: 1091 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agagaccatagaaggagtcgt

SEQ ID NO: 1092 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gagaccatagaaggagtcgat

SEQ ID NO: 1093 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agaccatagaaggagtcgatt

SEQ ID NO: 1094 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaccatagaaggagtcgatgt

SEQ ID NO: 1095 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
accatagaaggagtcgatgct

SEQ ID NO: 1096 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccttcaggctccatgaacatt

SEQ ID NO: 1097 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcaggctccatgaacatctat

SEQ ID NO: 1098 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caggctccatgaacatctact

SEQ ID NO: 1099 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgaacatctacctggtgctat

SEQ ID NO: 1100 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacatctacctggtgctagat

SEQ ID NO: 1101 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
catctacctggtgctagatgt

SEQ ID NO: 1102 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atctacctggtgctagatggt

SEQ ID NO: 1103 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tctacctggtgctagatggat

SEQ ID NO: 1104 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctacctggtgctagatggatt

SEQ ID NO: 1105 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacctggtgctagatggatct

SEQ ID NO: 1106 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acctggtgctagatggatcat

SEQ ID NO: 1107 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cctggtgctagatggatcagt

SEQ ID NO: 1108 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggtgctagatggatcagact

SEQ ID NO: 1109 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgctagatggatcagacagt

SEQ ID NO: 1110 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgctagatggatcagacagct

SEQ ID NO: 1111 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gatggatcagacagcattggt

SEQ ID NO: 1112 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caacttcacaggagccaaaat

SEQ ID NO: 1113 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacttcacaggagccaaaaat

SEQ ID NO: 1114 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acttcacaggagccaaaaagt

SEQ ID NO: 1115 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cttcacaggagccaaaaagtt

SEQ ID NO: 1116 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttcacaggagccaaaaagtgt

SEQ ID NO: 1117 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcacaggagccaaaaagtgtt

SEQ ID NO: 1118 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cacaggagccaaaaagtgtct

SEQ ID NO: 1119 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acaggagccaaaaagtgtctt

SEQ ID NO: 1120 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caggagccaaaaagtgtctat

SEQ ID NO: 1121 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aggagccaaaaagtgtctagt

SEQ ID NO: 1122 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggagccaaaaagtgtctagtt

SEQ ID NO: 1123 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gagccaaaaagtgtctagtct

SEQ ID NO: 1124 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agccaaaaagtgtctagtcat

SEQ ID NO: 1125 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gccaaaaagtgtctagtcaat

SEQ ID NO: 1126 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccaaaaagtgtctagtcaact

SEQ ID NO: 1127 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caaaaagtgtctagtcaactt

SEQ ID NO: 1128 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaaaagtgtctagtcaacttt

SEQ ID NO: 1129 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaaagtgtctagtcaacttat

SEQ ID NO: 1130 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaagtgtctagtcaacttaat

SEQ ID NO: 1131 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagtgtctagtcaacttaatt

SEQ ID NO: 1132 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agtgtctagtcaacttaattt

SEQ ID NO: 1133 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgtctagtcaacttaattgt

SEQ ID NO: 1134 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgtctagtcaacttaattgat

SEQ ID NO: 1135 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtctagtcaacttaattgagt

SEQ ID NO: 1136 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agtcaacttaattgagaaggt

SEQ ID NO: 1137 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
taattgagaaggtggcaagtt

SEQ ID NO: 1138 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aattgagaaggtggcaagttt

SEQ ID NO: 1139 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gagaaggtggcaagttatggt

SEQ ID NO: 1140 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agaaggtggcaagttatggtt

SEQ ID NO: 1141 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaggtggcaagttatggtgtt

SEQ ID NO: 1142 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aggtggcaagttatggtgtgt

SEQ ID NO: 1143 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcaagttatggtgtgaagcct

SEQ ID NO: 1144 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gttatggtgtgaagccaagat

SEQ ID NO: 1145 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atggtgtgaagccaagatatt

SEQ ID NO: 1146 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggtgtgaagccaagatatgt

SEQ ID NO: 1147 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaaatttgggtcaaagtgtct

SEQ ID NO: 1148 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaatttgggtcaaagtgtctt

SEQ ID NO: 1149 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atttgggtcaaagtgtctgat

SEQ ID NO: 1150 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtaatgcagactgggtcacgt

SEQ ID NO: 1151 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
taatgcagactgggtcacgat

SEQ ID NO: 1152 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aatgcagactgggtcacgaat

SEQ ID NO: 1153 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgcagactgggtcacgaagt

SEQ ID NO: 1154 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aatgaaatcaattatgaagat

SEQ ID NO: 1155 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgaaatcaattatgaagacct

SEQ ID NO: 1156 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aatcaattatgaagaccacat

SEQ ID NO: 1157 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atcaattatgaagaccacaat

SEQ ID NO: 1158 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcaattatgaagaccacaagt

SEQ ID NO: 1159 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caattatgaagaccacaagtt

SEQ ID NO: 1160 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aattatgaagaccacaagttt

SEQ ID NO: 1161 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
attatgaagaccacaagttgt

SEQ ID NO: 1162 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttatgaagaccacaagttgat

SEQ ID NO: 1163 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tatgaagaccacaagttgaat

SEQ ID NO: 1164 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgaagaccacaagttgaagt

SEQ ID NO: 1165 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgaagaccacaagttgaagtt

SEQ ID NO: 1166 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaagaccacaagttgaagtct

SEQ ID NO: 1167 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagaccacaagttgaagtcat

SEQ ID NO: 1168 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agaccacaagttgaagtcagt

SEQ ID NO: 1169 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
accacaagttgaagtcagggt

SEQ ID NO: 1170 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccacaagttgaagtcagggat

SEQ ID NO: 1171 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cacaagttgaagtcagggact

SEQ ID NO: 1172 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acaagttgaagtcagggactt

SEQ ID NO: 1173 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagttgaagtcagggactaat

SEQ ID NO: 1174 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttgaagtcagggactaacact

SEQ ID NO: 1175 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgaagtcagggactaacacct

SEQ ID NO: 1176 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agtcagggactaacaccaagt

SEQ ID NO: 1177 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtcagggactaacaccaagat

SEQ ID NO: 1178 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccaggcagtgtacagcatgat

SEQ ID NO: 1179 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caggcagtgtacagcatgatt

SEQ ID NO: 1180 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aggcagtgtacagcatgatgt

SEQ ID NO: 1181 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcagtgtacagcatgatgagt

SEQ ID NO: 1182 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctgatggattgcacaacatgt

SEQ ID NO: 1183 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgatggattgcacaacatggt

SEQ ID NO: 1184 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gatggattgcacaacatgggt

SEQ ID NO: 1185 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atggattgcacaacatgggct

SEQ ID NO: 1186 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggattgcacaacatgggcgt

SEQ ID NO: 1187 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggattgcacaacatgggcggt

SEQ ID NO: 1188 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gacccaattactgtcattgat

SEQ ID NO: 1189 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acccaattactgtcattgatt

SEQ ID NO: 1190 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccaattactgtcattgatgat

SEQ ID NO: 1191 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgtcattgatgagatccgggt

SEQ ID NO: 1192 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtcattgatgagatccgggat

SEQ ID NO: 1193 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cattgatgagatccgggactt

SEQ ID NO: 1194 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
attgatgagatccgggacttt

SEQ ID NO: 1195 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttggcaaggatcgcaaaaact

SEQ ID NO: 1196 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggcaaggatcgcaaaaacct

SEQ ID NO: 1197 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggcaaggatcgcaaaaaccct

SEQ ID NO: 1198 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caagggaggattatctggatt

SEQ ID NO: 1199 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaggattatctggatgtctat

SEQ ID NO: 1200 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aggattatctggatgtctatt

SEQ ID NO: 1201 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggattatctggatgtctatgt

SEQ ID NO: 1202 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gattatctggatgtctatgtt

SEQ ID NO: 1203 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
attatctggatgtctatgtgt

SEQ ID NO: 1204 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttatctggatgtctatgtgtt

SEQ ID NO: 1205 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tatctggatgtctatgtgttt

SEQ ID NO: 1206 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atctggatgtctatgtgtttt

SEQ ID NO: 1207 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tctggatgtctatgtgtttgt

SEQ ID NO: 1208 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctggatgtctatgtgtttggt

SEQ ID NO: 1209 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaccaagtgaacatcaatgct

SEQ ID NO: 1210 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
accaagtgaacatcaatgctt

SEQ ID NO: 1211 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccaagtgaacatcaatgcttt

SEQ ID NO: 1212 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caagtgaacatcaatgctttt

SEQ ID NO: 1213 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atcaatgctttggcttccaat

SEQ ID NO: 1214 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcaatgctttggcttccaagt

SEQ ID NO: 1215 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caatgctttggcttccaagat

SEQ ID NO: 1216 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggcttccaagaaagacaatt

SEQ ID NO: 1217 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttccaagaaagacaatgagct

SEQ ID NO: 1218 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tccaagaaagacaatgagcat

SEQ ID NO: 1219 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caagaaagacaatgagcaact

SEQ ID NO: 1220 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagaaagacaatgagcaacat

SEQ ID NO: 1221 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaagacaatgagcaacatgtt

SEQ ID NO: 1222 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agacaatgagcaacatgtgtt

SEQ ID NO: 1223 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gacaatgagcaacatgtgttt

SEQ ID NO: 1224 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acaatgagcaacatgtgttct

SEQ ID NO: 1225 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caatgagcaacatgtgttcat

SEQ ID NO: 1226 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgagcaacatgtgttcaaat

SEQ ID NO: 1227 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gagcaacatgtgttcaaagtt

SEQ ID NO: 1228 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agcaacatgtgttcaaagtct

SEQ ID NO: 1229 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caacatgtgttcaaagtcaat

SEQ ID NO: 1230 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacatgtgttcaaagtcaagt

SEQ ID NO: 1231 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acatgtgttcaaagtcaaggt

SEQ ID NO: 1232 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgtgttcaaagtcaaggatt

SEQ ID NO: 1233 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgtgttcaaagtcaaggatat

SEQ ID NO: 1234 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgttcaaagtcaaggatatt

SEQ ID NO: 1235 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttcaaagtcaaggatatggat

SEQ ID NO: 1236 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcaaagtcaaggatatggaat

SEQ ID NO: 1237 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caaagtcaaggatatggaaat

SEQ ID NO: 1238 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgaaagccagtctctgagtct

SEQ ID NO: 1239 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaaagccagtctctgagtctt

SEQ ID NO: 1240 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgagtctctgtggcatggttt

SEQ ID NO: 1241 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tctctgtggcatggtttgggt

SEQ ID NO: 1242 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgtggcatggtttgggaacat

SEQ ID NO: 1243 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggcatggtttgggaacacat

SEQ ID NO: 1244 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagggtaccgattaccacaat

SEQ ID NO: 1245 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gggtaccgattaccacaagct

SEQ ID NO: 1246 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
taccgattaccacaagcaact

SEQ ID NO: 1247 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccgattaccacaagcaaccat

SEQ ID NO: 1248 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cgattaccacaagcaaccatt

SEQ ID NO: 1249 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
attaccacaagcaaccatggt

SEQ ID NO: 1250 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttaccacaagcaaccatggct

SEQ ID NO: 1251 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
taccacaagcaaccatggcat

SEQ ID NO: 1252 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
accacaagcaaccatggcagt

SEQ ID NO: 1253 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagcaaccatggcaggccaat

SEQ ID NO: 1254 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
accatggcaggccaagatctt

SEQ ID NO: 1255 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccatggcaggccaagatctct

SEQ ID NO: 1256 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
catggcaggccaagatctcat

SEQ ID NO: 1257 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gctgtggtgtctgagtacttt

SEQ ID NO: 1258 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctgtggtgtctgagtactttt

SEQ ID NO: 1259 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgtggtgtctgagtactttgt

SEQ ID NO: 1260 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtggtgtctgagtactttgtt

SEQ ID NO: 1261 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggtgtctgagtactttgtgt

SEQ ID NO: 1262 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctgacagcagcacattgtttt

SEQ ID NO: 1263 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagcgggacctggagatagat

SEQ ID NO: 1264 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agcgggacctggagatagaat

SEQ ID NO: 1265 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaagcaggaattcctgaattt

SEQ ID NO: 1266 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagcaggaattcctgaatttt

SEQ ID NO: 1267 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcaggaattcctgaattttat

SEQ ID NO: 1268 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caggaattcctgaattttatt

SEQ ID NO: 1269 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aggaattcctgaattttatgt

SEQ ID NO: 1270 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggaattcctgaattttatgat

SEQ ID NO: 1271 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaattcctgaattttatgact

SEQ ID NO: 1272 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aattcctgaattttatgactt

SEQ ID NO: 1273 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
attcctgaattttatgactat

SEQ ID NO: 1274 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttcctgaattttatgactatt

SEQ ID NO: 1275 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcctgaattttatgactatgt

SEQ ID NO: 1276 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cctgaattttatgactatgat

SEQ ID NO: 1277 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctgaattttatgactatgact

SEQ ID NO: 1278 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaattttatgactatgacgtt

SEQ ID NO: 1279 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aattttatgactatgacgttt

SEQ ID NO: 1280 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
attttatgactatgacgttgt

SEQ ID NO: 1281 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tttatgactatgacgttgcct

SEQ ID NO: 1282 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttatgactatgacgttgccct

SEQ ID NO: 1283 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tatgactatgacgttgccctt

SEQ ID NO: 1284 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgactatgacgttgccctgt

SEQ ID NO: 1285 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgactatgacgttgccctgat

SEQ ID NO: 1286 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gactatgacgttgccctgatt

SEQ ID NO: 1287 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgacgttgccctgatcaagt

SEQ ID NO: 1288 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgacgttgccctgatcaagct

SEQ ID NO: 1289 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gacgttgccctgatcaagctt

SEQ ID NO: 1290 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acgttgccctgatcaagctct

SEQ ID NO: 1291 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gttgccctgatcaagctcaat

SEQ ID NO: 1292 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttgccctgatcaagctcaagt

SEQ ID NO: 1293 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cagactatcaggcccatttgt

SEQ ID NO: 1294 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agactatcaggcccatttgtt

SEQ ID NO: 1295 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gactatcaggcccatttgtct

SEQ ID NO: 1296 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
actatcaggcccatttgtctt

SEQ ID NO: 1297 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctatcaggcccatttgtctct

SEQ ID NO: 1298 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cgagggaacaactcgagcttt

SEQ ID NO: 1299 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gagggaacaactcgagctttt

SEQ ID NO: 1300 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agggaacaactcgagctttgt

SEQ ID NO: 1301 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaacaactcgagctttgaggt

SEQ ID NO: 1302 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacaactcgagctttgaggct

SEQ ID NO: 1303 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caactcgagctttgaggcttt

SEQ ID NO: 1304 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aactcgagctttgaggcttct

SEQ ID NO: 1305 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
actcgagctttgaggcttcct

SEQ ID NO: 1306 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gagctttgaggcttcctccat

SEQ ID NO: 1307 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agctttgaggcttcctccaat

SEQ ID NO: 1308 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gctttgaggcttcctccaact

SEQ ID NO: 1309 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctttgaggcttcctccaactt

SEQ ID NO: 1310 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tttgaggcttcctccaactat

SEQ ID NO: 1311 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaggcttcctccaactaccat

SEQ ID NO: 1312 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aggcttcctccaactaccact

SEQ ID NO: 1313 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcttcctccaactaccacttt

SEQ ID NO: 1314 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttcctccaactaccacttgct

SEQ ID NO: 1315 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcctccaactaccacttgcct

SEQ ID NO: 1316 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caactaccacttgccagcaat

SEQ ID NO: 1317 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
actaccacttgccagcaacat

SEQ ID NO: 1318 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctccctgcacaggatatcaat

SEQ ID NO: 1319 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tccctgcacaggatatcaaat

SEQ ID NO: 1320 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccctgcacaggatatcaaagt

SEQ ID NO: 1321 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctgcacaggatatcaaagctt

SEQ ID NO: 1322 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caggatatcaaagctctgttt

SEQ ID NO: 1323 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gatatcaaagctctgtttgtt

SEQ ID NO: 1324 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaagctctgtttgtgtctgat

SEQ ID NO: 1325 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gctgactcggaaggaggtctt

SEQ ID NO: 1326 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctgactcggaaggaggtctat

SEQ ID NO: 1327 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
actcggaaggaggtctacatt

SEQ ID NO: 1328 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcggaaggaggtctacatcat

SEQ ID NO: 1329 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cggaaggaggtctacatcaat

SEQ ID NO: 1330 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaggaggtctacatcaagaat

SEQ ID NO: 1331 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aggaggtctacatcaagaatt

SEQ ID NO: 1332 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagaaaggcagctgtgagagt

SEQ ID NO: 1333 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaaggcagctgtgagagagat

SEQ ID NO: 1334 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agctgtgagagagatgctcat

SEQ ID NO: 1335 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctgtgagagagatgctcaatt

SEQ ID NO: 1336 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgtgagagagatgctcaatat

SEQ ID NO: 1337 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgagagagatgctcaatatt

SEQ ID NO: 1338 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgagagagatgctcaatatgt

SEQ ID NO: 1339 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gagagagatgctcaatatgct

SEQ ID NO: 1340 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caggctatgacaaagtcaagt

SEQ ID NO: 1341 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aggctatgacaaagtcaaggt

SEQ ID NO: 1342 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggctatgacaaagtcaaggat

SEQ ID NO: 1343 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gacaaagtcaaggacatctct

SEQ ID NO: 1344 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcggttcctttgtactggagt

SEQ ID NO: 1345 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cggttcctttgtactggaggt

SEQ ID NO: 1346 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggttcctttgtactggaggat

SEQ ID NO: 1347 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttcctttgtactggaggagtt

SEQ ID NO: 1348 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cctttgtactggaggagtgat

SEQ ID NO: 1349 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttgtactggaggagtgagtct

SEQ ID NO: 1350 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgtactggaggagtgagtcct

SEQ ID NO: 1351 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtactggaggagtgagtccct

SEQ ID NO: 1352 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
actggaggagtgagtccctat

SEQ ID NO: 1353 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggaggagtgagtccctatgt

SEQ ID NO: 1354 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaggagtgagtccctatgctt

SEQ ID NO: 1355 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggagtgagtccctatgctgat

SEQ ID NO: 1356 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gagtgagtccctatgctgact

SEQ ID NO: 1357 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caatacttgcagaggtgattt

SEQ ID NO: 1358 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aatacttgcagaggtgattct

SEQ ID NO: 1359 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacttgcagaggtgattctgt

SEQ ID NO: 1360 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cttgcagaggtgattctggct

SEQ ID NO: 1361 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttgcagaggtgattctggcgt

SEQ ID NO: 1362 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgatagttcacaagagaagtt

SEQ ID NO: 1363 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gatagttcacaagagaagtct

SEQ ID NO: 1364 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atagttcacaagagaagtcgt

SEQ ID NO: 1365 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tagttcacaagagaagtcgtt

SEQ ID NO: 1366 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agttcacaagagaagtcgttt

SEQ ID NO: 1367 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gttcacaagagaagtcgtttt

SEQ ID NO: 1368 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttcacaagagaagtcgtttct

SEQ ID NO: 1369 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcacaagagaagtcgtttcat

SEQ ID NO: 1370 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cacaagagaagtcgtttcatt

SEQ ID NO: 1371 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acaagagaagtcgtttcattt

SEQ ID NO: 1372 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caagagaagtcgtttcattct

SEQ ID NO: 1373 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagagaagtcgtttcattcat

SEQ ID NO: 1374 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agagaagtcgtttcattcaat

SEQ ID NO: 1375 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gagaagtcgtttcattcaagt

SEQ ID NO: 1376 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agaagtcgtttcattcaagtt

SEQ ID NO: 1377 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaagtcgtttcattcaagttt

SEQ ID NO: 1378 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagtcgtttcattcaagttgt

SEQ ID NO: 1379 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agtcgtttcattcaagttggt

SEQ ID NO: 1380 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gagtagtggatgtctgcaaat

SEQ ID NO: 1381 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agtagtggatgtctgcaaaat

SEQ ID NO: 1382 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtagtggatgtctgcaaaaat

SEQ ID NO: 1383 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tagtggatgtctgcaaaaact

SEQ ID NO: 1384 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agtggatgtctgcaaaaacct

SEQ ID NO: 1385 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtggatgtctgcaaaaaccat

SEQ ID NO: 1386 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggatgtctgcaaaaaccagt

SEQ ID NO: 1387 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggatgtctgcaaaaaccagat

SEQ ID NO: 1388 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gatgtctgcaaaaaccagaat

SEQ ID NO: 1389 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtctgcaaaaaccagaagcgt

SEQ ID NO: 1390 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tctgcaaaaaccagaagcggt

SEQ ID NO: 1391 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctgcaaaaaccagaagcggct

SEQ ID NO: 1392 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caaaaaccagaagcggcaaat

SEQ ID NO: 1393 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaaaaccagaagcggcaaaat

SEQ ID NO: 1394 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaaaccagaagcggcaaaagt

SEQ ID NO: 1395 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaaccagaagcggcaaaagct

SEQ ID NO: 1396 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaccagaagcggcaaaagcat

SEQ ID NO: 1397 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agaagcggcaaaagcaggtat

SEQ ID NO: 1398 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaagcaggtacctgctcacgt

SEQ ID NO: 1399 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caagtgctgccctggctgaat

SEQ ID NO: 1400 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggctgaaggagaaactccat

SEQ ID NO: 1401 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aactccaagatgaggatttgt

SEQ ID NO: 1402 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tccaagatgaggatttgggtt

SEQ ID NO: 1403 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caagatgaggatttgggtttt

SEQ ID NO: 1404 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agatgaggatttgggttttct

SEQ ID NO: 1405 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgggattgaattaaaacagt

SEQ ID NO: 1406 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgggattgaattaaaacagct

SEQ ID NO: 1407 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gggattgaattaaaacagctt

SEQ ID NO: 1408 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
attgaattaaaacagctgcgt

SEQ ID NO: 1409 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttgaattaaaacagctgcgat

SEQ ID NO: 1410 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgaattaaaacagctgcgact

SEQ ID NO: 1411 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaattaaaacagctgcgacat

SEQ ID NO: 1412 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctggcttctacccgtaccctt

SEQ ID NO: 1413 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccctactacaatgtgagtgat

SEQ ID NO: 1414 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cctactacaatgtgagtgatt

SEQ ID NO: 1415 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
actacaatgtgagtgatgagt

SEQ ID NO: 1416 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acaatgtgagtgatgagatct

SEQ ID NO: 1417 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caatgtgagtgatgagatctt

SEQ ID NO: 1418 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aatgtgagtgatgagatctct

SEQ ID NO: 1419 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgtgagtgatgagatctctt

SEQ ID NO: 1420 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgtgagtgatgagatctcttt

SEQ ID NO: 1421 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgagtgatgagatctctttt

SEQ ID NO: 1422 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgagtgatgagatctctttct

SEQ ID NO: 1423 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gagtgatgagatctctttcct

SEQ ID NO: 1424 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agtgatgagatctctttccat

SEQ ID NO: 1425 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgatgagatctctttccactt

SEQ ID NO: 1426 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tctctttccactgctatgact

SEQ ID NO: 1427 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
actgctatgacggttacactt

SEQ ID NO: 1428 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cagacagcgatctgtgacaat

SEQ ID NO: 1429 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cttgaagacagcgtcacctat

SEQ ID NO: 1430 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagactccttcatgtacgact

SEQ ID NO: 1431 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gactccttcatgtacgacact

SEQ ID NO: 1432 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agagaccatagaaggagtcgt

SEQ ID NO: 1433 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agaccatagaaggagtcgatt

SEQ ID NO: 1434 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaccatagaaggagtcgatgt

SEQ ID NO: 1435 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgaacatctacctggtgctat

SEQ ID NO: 1436 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggtgctagatggatcagact

SEQ ID NO: 1437 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgctagatggatcagacagt

SEQ ID NO: 1438 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caacttcacaggagccaaaat

SEQ ID NO: 1439 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacttcacaggagccaaaaat

SEQ ID NO: 1440 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cttcacaggagccaaaaagtt

SEQ ID NO: 1441 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggagccaaaaagtgtctagtt

SEQ ID NO: 1442 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gagccaaaaagtgtctagtct

SEQ ID NO: 1443 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gccaaaaagtgtctagtcaat

SEQ ID NO: 1444 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccaaaaagtgtctagtcaact

SEQ ID NO: 1445 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caaaaagtgtctagtcaactt

SEQ ID NO: 1446 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaaaagtgtctagtcaacttt

SEQ ID NO: 1447 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaaagtgtctagtcaacttat

SEQ ID NO: 1448 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaagtgtctagtcaacttaat

SEQ ID NO: 1449 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtctagtcaacttaattgagt

SEQ ID NO: 1450 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
taattgagaaggtggcaagtt

SEQ ID NO: 1451 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaggtggcaagttatggtgtt

SEQ ID NO: 1452 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcaagttatggtgtgaagcct

SEQ ID NO: 1453 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atggtgtgaagccaagatatt

SEQ ID NO: 1454 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaaatttgggtcaaagtgtct

SEQ ID NO: 1455 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaatttgggtcaaagtgtctt

SEQ ID NO: 1456 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atttgggtcaaagtgtctgat

SEQ ID NO: 1457 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtaatgcagactgggtcacgt

SEQ ID NO: 1458 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aatgaaatcaattatgaagat

SEQ ID NO: 1459 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcaattatgaagaccacaagt

SEQ ID NO: 1460 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caattatgaagaccacaagtt

SEQ ID NO: 1461 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
attatgaagaccacaagttgt

SEQ ID NO: 1462 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttatgaagaccacaagttgat

SEQ ID NO: 1463 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tatgaagaccacaagttgaat

SEQ ID NO: 1464 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgaagaccacaagttgaagt

SEQ ID NO: 1465 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgaagaccacaagttgaagtt

SEQ ID NO: 1466 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaagaccacaagttgaagtct

SEQ ID NO: 1467 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagaccacaagttgaagtcat

SEQ ID NO: 1468 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cacaagttgaagtcagggact

SEQ ID NO: 1469 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acaagttgaagtcagggactt

SEQ ID NO: 1470 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aggcagtgtacagcatgatgt

SEQ ID NO: 1471 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcagtgtacagcatgatgagt

SEQ ID NO: 1472 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gatggattgcacaacatgggt

SEQ ID NO: 1473 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atggattgcacaacatgggct

SEQ ID NO: 1474 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggattgcacaacatgggcggt

SEQ ID NO: 1475 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gacccaattactgtcattgat

SEQ ID NO: 1476 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acccaattactgtcattgatt

SEQ ID NO: 1477 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccaattactgtcattgatgat

SEQ ID NO: 1478 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
attgatgagatccgggacttt

SEQ ID NO: 1479 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttggcaaggatcgcaaaaact

SEQ ID NO: 1480 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caagggaggattatctggatt

SEQ ID NO: 1481 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaggattatctggatgtctat

SEQ ID NO: 1482 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aggattatctggatgtctatt

SEQ ID NO: 1483 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggattatctggatgtctatgt

SEQ ID NO: 1484 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gattatctggatgtctatgtt

SEQ ID NO: 1485 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
attatctggatgtctatgtgt

SEQ ID NO: 1486 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttatctggatgtctatgtgtt

SEQ ID NO: 1487 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tatctggatgtctatgtgttt

SEQ ID NO: 1488 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atctggatgtctatgtgtttt

SEQ ID NO: 1489 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tctggatgtctatgtgtttgt

SEQ ID NO: 1490 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaccaagtgaacatcaatgct

SEQ ID NO: 1491 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
accaagtgaacatcaatgctt

SEQ ID NO: 1492 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccaagtgaacatcaatgcttt

SEQ ID NO: 1493 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caagtgaacatcaatgctttt

SEQ ID NO: 1494 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atcaatgctttggcttccaat

SEQ ID NO: 1495 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caatgctttggcttccaagat

SEQ ID NO: 1496 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggcttccaagaaagacaatt

SEQ ID NO: 1497 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttccaagaaagacaatgagct

SEQ ID NO: 1498 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tccaagaaagacaatgagcat

SEQ ID NO: 1499 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagaaagacaatgagcaacat

SEQ ID NO: 1500 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaagacaatgagcaacatgtt

SEQ ID NO: 1501 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agacaatgagcaacatgtgtt

SEQ ID NO: 1502 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gacaatgagcaacatgtgttt

SEQ ID NO: 1503 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acaatgagcaacatgtgttct

SEQ ID NO: 1504 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caatgagcaacatgtgttcat

SEQ ID NO: 1505 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgagcaacatgtgttcaaat

SEQ ID NO: 1506 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gagcaacatgtgttcaaagtt

SEQ ID NO: 1507 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caacatgtgttcaaagtcaat

SEQ ID NO: 1508 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacatgtgttcaaagtcaagt

SEQ ID NO: 1509 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acatgtgttcaaagtcaaggt

SEQ ID NO: 1510 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgtgttcaaagtcaaggatt

SEQ ID NO: 1511 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgtgttcaaagtcaaggatat

SEQ ID NO: 1512 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgttcaaagtcaaggatatt

SEQ ID NO: 1513 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttcaaagtcaaggatatggat

SEQ ID NO: 1514 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcaaagtcaaggatatggaat

SEQ ID NO: 1515 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
taccgattaccacaagcaact

SEQ ID NO: 1516 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccgattaccacaagcaaccat

SEQ ID NO: 1517 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
attaccacaagcaaccatggt

SEQ ID NO: 1518 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
accacaagcaaccatggcagt

SEQ ID NO: 1519 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggtgtctgagtactttgtgt

SEQ ID NO: 1520 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaagcaggaattcctgaattt

SEQ ID NO: 1521 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagcaggaattcctgaatttt

SEQ ID NO: 1522 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcaggaattcctgaattttat

SEQ ID NO: 1523 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caggaattcctgaattttatt

SEQ ID NO: 1524 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaattcctgaattttatgact

SEQ ID NO: 1525 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aattcctgaattttatgactt

SEQ ID NO: 1526 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
attcctgaattttatgactat

SEQ ID NO: 1527 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttcctgaattttatgactatt

SEQ ID NO: 1528 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cctgaattttatgactatgat

SEQ ID NO: 1529 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctgaattttatgactatgact

SEQ ID NO: 1530 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaattttatgactatgacgtt

SEQ ID NO: 1531 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aattttatgactatgacgttt

SEQ ID NO: 1532 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
attttatgactatgacgttgt

SEQ ID NO: 1533 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tttatgactatgacgttgcct

SEQ ID NO: 1534 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgactatgacgttgccctgt

SEQ ID NO: 1535 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cagactatcaggcccatttgt

SEQ ID NO: 1536 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agactatcaggcccatttgtt

SEQ ID NO: 1537 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cgagggaacaactcgagcttt

SEQ ID NO: 1538 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gagggaacaactcgagctttt

SEQ ID NO: 1539 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aacaactcgagctttgaggct

SEQ ID NO: 1540 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gcttcctccaactaccacttt

SEQ ID NO: 1541 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctgcacaggatatcaaagctt

SEQ ID NO: 1542 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caggatatcaaagctctgttt

SEQ ID NO: 1543 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gatatcaaagctctgtttgtt

SEQ ID NO: 1544 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaagctctgtttgtgtctgat

SEQ ID NO: 1545 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagaaaggcagctgtgagagt

SEQ ID NO: 1546 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agctgtgagagagatgctcat

SEQ ID NO: 1547 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctgtgagagagatgctcaatt

SEQ ID NO: 1548 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgtgagagagatgctcaatat

SEQ ID NO: 1549 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgagagagatgctcaatatt

SEQ ID NO: 1550 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgagagagatgctcaatatgt

SEQ ID NO: 1551 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gagagagatgctcaatatgct

SEQ ID NO: 1552 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caggctatgacaaagtcaagt

SEQ ID NO: 1553 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggctatgacaaagtcaaggat

SEQ ID NO: 1554 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gacaaagtcaaggacatctct

SEQ ID NO: 1555 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttgtactggaggagtgagtct

SEQ ID NO: 1556 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aatacttgcagaggtgattct

SEQ ID NO: 1557 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacttgcagaggtgattctgt

SEQ ID NO: 1558 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgatagttcacaagagaagtt

SEQ ID NO: 1559 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gatagttcacaagagaagtct

SEQ ID NO: 1560 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atagttcacaagagaagtcgt

SEQ ID NO: 1561 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tagttcacaagagaagtcgtt

SEQ ID NO: 1562 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agttcacaagagaagtcgttt

SEQ ID NO: 1563 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gttcacaagagaagtcgtttt

SEQ ID NO: 1564 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttcacaagagaagtcgtttct

SEQ ID NO: 1565 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcacaagagaagtcgtttcat

SEQ ID NO: 1566 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cacaagagaagtcgtttcatt

SEQ ID NO: 1567 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acaagagaagtcgtttcattt

SEQ ID NO: 1568 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caagagaagtcgtttcattct

SEQ ID NO: 1569 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagagaagtcgtttcattcat

SEQ ID NO: 1570 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gagaagtcgtttcattcaagt

SEQ ID NO: 1571 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agaagtcgtttcattcaagtt

SEQ ID NO: 1572 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gaagtcgtttcattcaagttt

SEQ ID NO: 1573 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagtcgtttcattcaagttgt

SEQ ID NO: 1574 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agtcgtttcattcaagttggt

SEQ ID NO: 1575 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gagtagtggatgtctgcaaat

SEQ ID NO: 1576 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agtagtggatgtctgcaaaat

SEQ ID NO: 1577 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtagtggatgtctgcaaaaat

SEQ ID NO: 1578 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tagtggatgtctgcaaaaact

SEQ ID NO: 1579 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggatgtctgcaaaaaccagat

SEQ ID NO: 1580 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gatgtctgcaaaaaccagaat

SEQ ID NO: 1581 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtctgcaaaaaccagaagcgt

SEQ ID NO: 1582 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tctgcaaaaaccagaagcggt

SEQ ID NO: 1583 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaaaaccagaagcggcaaaat

SEQ ID NO: 1584 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaaaccagaagcggcaaaagt

SEQ ID NO: 1585 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaccagaagcggcaaaagcat

SEQ ID NO: 1586 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agaagcggcaaaagcaggtat

SEQ ID NO: 1587 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aactccaagatgaggatttgt

SEQ ID NO: 1588 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tccaagatgaggatttgggtt

SEQ ID NO: 1589 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caagatgaggatttgggtttt

SEQ ID NO: 1590 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agatgaggatttgggttttct

SEQ ID NO: 1591 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtgggattgaattaaaacagt

SEQ ID NO: 1592 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgggattgaattaaaacagct

SEQ ID NO: 1593 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gggattgaattaaaacagctt

SEQ ID NO: 1594 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
attgaattaaaacagctgcgt

SEQ ID NO: 1595 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aagggaatgtgaccaggtctt

SEQ ID NO: 1596 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aggtctaggtctggagtttct

SEQ ID NO: 1597 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tctggagtttcagcttggact

SEQ ID NO: 1598 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctggagtttcagcttggacat

SEQ ID NO: 1599 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tccttctggcttctacccgtt

SEQ ID NO: 1600 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctacccgtaccctgtgcagat

SEQ ID NO: 1601 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgcagacacgtacctgcagat

SEQ ID NO: 1602 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaggcagagtgcagagcaatt

SEQ ID NO: 1603 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctctttccactgctatgacgt

SEQ ID NO: 1604 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctgctatgacggttacactct

SEQ ID NO: 1605 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcgcacctgccaagtgaatgt

SEQ ID NO: 1606 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gacagcgatctgtgacaacgt

SEQ ID NO: 1607 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggcacaaggaaggtgggcat

SEQ ID NO: 1608 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttgaagacagcgtcacctact

SEQ ID NO: 1609 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agactccttcatgtacgacat

SEQ ID NO: 1610 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caagaggtggccgaagctttt

SEQ ID NO: 1611 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gagaccatagaaggagtcgat

SEQ ID NO: 1612 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caggctccatgaacatctact

SEQ ID NO: 1613 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atctacctggtgctagatggt

SEQ ID NO: 1614 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctacctggtgctagatggatt

SEQ ID NO: 1615 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tacctggtgctagatggatct

SEQ ID NO: 1616 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cacaggagccaaaaagtgtct

SEQ ID NO: 1617 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caggagccaaaaagtgtctat

SEQ ID NO: 1618 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agccaaaaagtgtctagtcat

SEQ ID NO: 1619 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluoroadenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agtcaacttaattgagaaggt

SEQ ID NO: 1620 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
taatgcagactgggtcacgat

SEQ ID NO: 1621 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgaaatcaattatgaagacct

SEQ ID NO: 1622 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aatcaattatgaagaccacat

SEQ ID NO: 1623 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
accacaagttgaagtcagggt

SEQ ID NO: 1624 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttgaagtcagggactaacact

SEQ ID NO: 1625 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgaagtcagggactaacacct

SEQ ID NO: 1626 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agtcagggactaacaccaagt

SEQ ID NO: 1627 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgatggattgcacaacatggt

SEQ ID NO: 1628 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorocytidine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggcaaggatcgcaaaaacct

SEQ ID NO: 1629 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggcaaggatcgcaaaaaccct

SEQ ID NO: 1630 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcaatgctttggcttccaagt

SEQ ID NO: 1631 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caagaaagacaatgagcaact

SEQ ID NO: 1632 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agcaacatgtgttcaaagtct

SEQ ID NO: 1633 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caaagtcaaggatatggaaat

SEQ ID NO: 1634 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgaaagccagtctctgagtct

SEQ ID NO: 1635 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggcatggtttgggaacacat

SEQ ID NO: 1636 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gggtaccgattaccacaagct

SEQ ID NO: 1637 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
cgattaccacaagcaaccatt

SEQ ID NO: 1638 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
taccacaagcaaccatggcat

SEQ ID NO: 1639 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
accatggcaggccaagatctt

SEQ ID NO: 1640 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
catggcaggccaagatctcat

SEQ ID NO: 1641 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctgtggtgtctgagtactttt

SEQ ID NO: 1642 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agcgggacctggagatagaat

SEQ ID NO: 1643 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyluridine-3'-phosphate
  modified_base 9: mod_base = OTHER; note = 2'-fluorouridine-3'-phosphate
  modified_base 10: mod_base = OTHER; note = 2'-fluorouridine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcctgaattttatgactatgt

SEQ ID NO: 1644 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluorocytidine-3'-phosphate
  modified_base 8: mod_base = OTHER; note = 2'-O-methyluridine-3'-phosphate
  modified_base 9: mod_base = OTHER; note = 2'-fluoroadenosine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttatgactatgacgttgccct

SEQ ID NO: 1645 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methyladenosine-3'-phosphate
  modified_base 9: mod_base = OTHER; note = 2'-fluorouridine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-O-methyluridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tatgactatgacgttgccctt

SEQ ID NO: 1646 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methyluridine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
atgacgttgccctgatcaagt

SEQ ID NO: 1647 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluorocytidine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgacgttgccctgatcaagct

SEQ ID NO: 1648 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
acgttgccctgatcaagctct

SEQ ID NO: 1649 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
caactcgagctttgaggcttt

SEQ ID NO: 1650 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluoroguanosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gctttgaggcttcctccaact

SEQ ID NO: 1651 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluorocytidine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aggcttcctccaactaccact

SEQ ID NO: 1652 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttcctccaactaccacttgct

SEQ ID NO: 1653 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ctccctgcacaggatatcaat

SEQ ID NO: 1654 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluorocytidine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tccctgcacaggatatcaaat

SEQ ID NO: 1655 - RNA, 21 nt, synthetic construct
  source 1..21: mol_type = other RNA
  modified_base 1: mod_base = OTHER; note = 2'-O-methylcytidine-3'- phosphorothioate
  modified_base 2: mod_base = OTHER; note = 2'-O-methylcytidine-3'- phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-O-methylcytidine-3'-phosphate
  modified_base 7: mod_base = OTHER; note = 2'-fluoroadenosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ccctgcacaggatatcaaagt

SEQ ID NO: 1656 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gctgactcggaaggaggtctt

SEQ ID NO: 1657 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylcytidine-3'- phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluoroguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-O-methyluridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tcggaaggaggtctacatcat

SEQ ID NO: 1658 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = 2'-fluorouridine-3'-phosphate
  modified_base 8: mod_base = OTHER; note = 2'-O-methylcytidine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aggaggtctacatcaagaatt

SEQ ID NO: 1659 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluorocytidine-3'-phosphate
  modified_base 11: mod_base = OTHER; note = 2'-fluoroadenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aggctatgacaaagtcaaggt

SEQ ID NO: 1660 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methyluridine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ttcctttgtactggaggagtt

SEQ ID NO: 1661 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtactggaggagtgagtccct

SEQ ID NO: 1662 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylcytidine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methylguanosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methylguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
actggaggagtgagtccctat

SEQ ID NO: 1663 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorocytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methyladenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
ggagtgagtccctatgctgat

SEQ ID NO: 1664 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methylguanosine-3'- phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-O-methyladenosine-3'-phosphate
  modified_base 7: mod_base = OTHER; note = 2'-fluorouridine-3'-phosphate
  modified_base 8: mod_base = OTHER; note = 2'-O-methylguanosine-3'-phosphate
  modified_base 9: mod_base = OTHER; note = 2'-fluorouridine-3'-phosphate
  modified_base 10: mod_base = OTHER; note = 2'-fluorocytidine-3'-phosphate
  modified_base 11: mod_base = OTHER; note = 2'-fluorouridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
agtggatgtctgcaaaaacct

SEQ ID NO: 1665 - RNA, 21 nt, synthetic construct
  source 1..21: mol_type = other RNA
  modified_base 1: mod_base = OTHER; note = 2'-O-methylguanosine-3'- phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-O-methyluridine-3'-phosphate
  modified_base 7: mod_base = OTHER; note = 2'-fluoroguanosine-3'-phosphate
  modified_base 8: mod_base = OTHER; note = 2'-O-methyluridine-3'-phosphate
  modified_base 9: mod_base = OTHER; note = 2'-fluorocytidine-3'-phosphate
  modified_base 10: mod_base = OTHER; note = 2'-fluorouridine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
gtggatgtctgcaaaaaccat

SEQ ID NO: 1666 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = 2'-fluoroguanosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aaaccagaagcggcaaaagct

SEQ ID NO: 1667 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-O-methylguanosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroguanosine-3'-phosphate
  modified_base 10: mod_base = OTHER; note = 2'-fluoroguanosine-3'-phosphate
  modified_base 11: mod_base = OTHER; note = 2'-fluoroadenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-O-methyladenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tggctgaaggagaaactccat

SEQ ID NO: 1668 - RNA, 21 nt, synthetic construct
  source 1..21: mol_type = other RNA
  modified_base 1: mod_base = OTHER; note = 2'-O-methyluridine-3'-phosphorothioate
  modified_base 2: mod_base = OTHER; note = 2'-O-methylguanosine-3'- phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-O-methyluridine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluoroadenosine-3'-phosphate
  modified_base 10: mod_base = OTHER; note = 2'-fluoroadenosine-3'-phosphate
  modified_base 11: mod_base = OTHER; note = 2'-fluorocytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
tgaattaaaacagctgcgact

SEQ ID NO: 1669 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-fluoroadenosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aattaaaacagctgcgacaat

SEQ ID NO: 1670 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyladenosine-3'- phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-fluorocytidine-3'-phosphate
  modified_base 10: mod_base = OTHER; note = 2'-fluoroadenosine-3'-phosphate
  modified_base 11: mod_base = OTHER; note = 2'-fluoroguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-O-methylguanosine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
aattaaaacagctgcgacaat

SEQ ID NO: 1671 - RNA, 21 nt, synthetic construct
  source 1..21: mol_type = other RNA
  modified_base 1: mod_base = OTHER; note = 2'-O-methyladenosine-3'- phosphorothioate
  modified_base 2: mod_base = OTHER; note = 2'-O-methyluridine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-fluoroadenosine-3'-phosphate
  modified_base 10: mod_base = OTHER; note = 2'-fluoroguanosine-3'-phosphate
  modified_base 11: mod_base = OTHER; note = 2'-fluorocytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methylcytidine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphate ((2S,4R)-1-[29-[[2-(acetylamino)-2-deoxy-beta-D-galactopyra nosyl]oxy]-14,14-bis[[3-[[3-[[5-[[2-(acetylamino)-2-deoxy-b eta-D-galactopyranosyl]oxy]-1-oxopentyl]amino]propyl]amino] -3-oxopropoxy]methyl]-1,12,19,25-tetraoxo-16-oxa-13,20,24-t riazanonacos-1-yl]-4-hydroxy-2-pyrrolidinyl)methyl ester
attaaaacagctgcgacaact

SEQ ID NO: 1672 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aagacctggtcacattcccttcc

SEQ ID NO: 1673 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atagacctggtcacattcccttc

SEQ ID NO: 1674 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
actagacctggtcacattccctt

SEQ ID NO: 1675 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acctagacctggtcacattccct

SEQ ID NO: 1676 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acagacctagacctggtcacatt

SEQ ID NO: 1677 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
accagacctagacctggtcacat

SEQ ID NO: 1678 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agaaactccagacctagacctgg

SEQ ID NO: 1679 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atccaagctgaaactccagacct

SEQ ID NO: 1680 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agtccaagctgaaactccagacc

SEQ ID NO: 1681 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atgtccaagctgaaactccagac

SEQ ID NO: 1682 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atcttggagaagtcggaaggagc

SEQ ID NO: 1683 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agggtagaagccagaaggacaca

SEQ ID NO: 1684 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aacgggtagaagccagaaggaca

SEQ ID NO: 1685 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atacgggtagaagccagaaggac

SEQ ID NO: 1686 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agtacgggtagaagccagaagga

SEQ ID NO: 1687 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aagggtacgggtagaagccagaa

SEQ ID NO: 1688 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atctgcacagggtacgggtagaa

SEQ ID NO: 1689 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atctgcaggtacgtgtctgcaca

SEQ ID NO: 1690 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aattgctctgcactctgccttcc

SEQ ID NO: 1691 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aggattgctctgcactctgcctt

SEQ ID NO: 1692 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aacattgtagtagggagaccggg

SEQ ID NO: 1693 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atcactcacattgtagtagggag

SEQ ID NO: 1694 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aatcactcacattgtagtaggga

SEQ ID NO: 1695 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acatcactcacattgtagtaggg

SEQ ID NO: 1696 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
actcatcactcacattgtagtag

SEQ ID NO: 1697 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agatctcatcactcacattgtag

SEQ ID NO: 1698 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aagatctcatcactcacattgta

SEQ ID NO: 1699 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agagatctcatcactcacattgt

SEQ ID NO: 1700 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aagagatctcatcactcacattg

SEQ ID NO: 1701 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaagagatctcatcactcacatt

SEQ ID NO: 1702 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaaagagatctcatcactcacat

SEQ ID NO: 1703 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agaaagagatctcatcactcaca

SEQ ID NO: 1704 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aggaaagagatctcatcactcac

SEQ ID NO: 1705 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atggaaagagatctcatcactca

SEQ ID NO: 1706 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agtggaaagagatctcatcactc

SEQ ID NO: 1707 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aagtggaaagagatctcatcact

SEQ ID NO: 1708 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acatagcagtggaaagagatctc

SEQ ID NO: 1709 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atcatagcagtggaaagagatct

SEQ ID NO: 1710 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agtcatagcagtggaaagagatc

SEQ ID NO: 1711 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acgtcatagcagtggaaagagat

SEQ ID NO: 1712 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
accgtcatagcagtggaaagaga

SEQ ID NO: 1713 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aagtgtaaccgtcatagcagtgg

SEQ ID NO: 1714 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agagtgtaaccgtcatagcagtg

SEQ ID NO: 1715 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acggagagtgtaaccgtcatagc

SEQ ID NO: 1716 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
accggagagtgtaaccgtcatag

SEQ ID NO: 1717 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aattcacttggcaggtgcgattg

SEQ ID NO: 1718 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acattcacttggcaggtgcgatt

SEQ ID NO: 1719 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
accattcacttggcaggtgcgat

SEQ ID NO: 1720 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
attgtcacagatcgctgtctgcc

SEQ ID NO: 1721 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agttgtcacagatcgctgtctgc

SEQ ID NO: 1722 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acgttgtcacagatcgctgtctg

SEQ ID NO: 1723 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
accgttgtcacagatcgctgtct

SEQ ID NO: 1724 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atccgttgtcacagatcgctgtc

SEQ ID NO: 1725 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
actccgttgtcacagatcgctgt

SEQ ID NO: 1726 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atgcccaccttccttgtgccaat

SEQ ID NO: 1727 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atgacgctgtcttcaaggcggta

SEQ ID NO: 1728 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
ataggtgacgctgtcttcaaggc

SEQ ID NO: 1729 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agtaggtgacgctgtcttcaagg

SEQ ID NO: 1730 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aggtaggtgacgctgtcttcaag

SEQ ID NO: 1731 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaagagccaccttcctgacacgt

SEQ ID NO: 1732 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaaggagtcttggcaggaaggct

SEQ ID NO: 1733 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aatgaaggagtcttggcaggaag

SEQ ID NO: 1734 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aacatgaaggagtcttggcagga

SEQ ID NO: 1735 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atacatgaaggagtcttggcagg

SEQ ID NO: 1736 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atcgtacatgaaggagtcttggc

SEQ ID NO: 1737 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agtcgtacatgaaggagtcttgg

SEQ ID NO: 1738 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atgtcgtacatgaaggagtcttg

SEQ ID NO: 1739 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agtgtcgtacatgaaggagtctt

SEQ ID NO: 1740 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaaagcttcggccacctcttgag

SEQ ID NO: 1741 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agaagacaggaaagcttcggcca

SEQ ID NO: 1742 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acgactccttctatggtctctgt

SEQ ID NO: 1743 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atcgactccttctatggtctctg

SEQ ID NO: 1744 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aatcgactccttctatggtctct

SEQ ID NO: 1745 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acatcgactccttctatggtctc

SEQ ID NO: 1746 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agcatcgactccttctatggtct

SEQ ID NO: 1747 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aatgttcatggagcctgaagggt

SEQ ID NO: 1748 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atagatgttcatggagcctgaag

SEQ ID NO: 1749 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agtagatgttcatggagcctgaa

SEQ ID NO: 1750 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atagcaccaggtagatgttcatg

SEQ ID NO: 1751 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atctagcaccaggtagatgttca

SEQ ID NO: 1752 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acatctagcaccaggtagatgtt

SEQ ID NO: 1753 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
accatctagcaccaggtagatgt

SEQ ID NO: 1754 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atccatctagcaccaggtagatg

SEQ ID NO: 1755 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aatccatctagcaccaggtagat

SEQ ID NO: 1756 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agatccatctagcaccaggtaga

SEQ ID NO: 1757 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atgatccatctagcaccaggtag

SEQ ID NO: 1758 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
actgatccatctagcaccaggta

SEQ ID NO: 1759 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agtctgatccatctagcaccagg

SEQ ID NO: 1760 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
actgtctgatccatctagcacca

SEQ ID NO: 1761 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agctgtctgatccatctagcacc

SEQ ID NO: 1762 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
accaatgctgtctgatccatcta

SEQ ID NO: 1763 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
attttggctcctgtgaagttgct

SEQ ID NO: 1764 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atttttggctcctgtgaagttgc

SEQ ID NO: 1765 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
actttttggctcctgtgaagttg

SEQ ID NO: 1766 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aactttttggctcctgtgaagtt

SEQ ID NO: 1767 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acactttttggctcctgtgaagt

SEQ ID NO: 1768 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aacactttttggctcctgtgaag

SEQ ID NO: 1769 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agacactttttggctcctgtgaa

SEQ ID NO: 1770 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aagacactttttggctcctgtga

SEQ ID NO: 1771 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atagacactttttggctcctgtg

SEQ ID NO: 1772 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
actagacactttttggctcctgt

SEQ ID NO: 1773 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aactagacactttttggctcctg

SEQ ID NO: 1774 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agactagacactttttggctcct

SEQ ID NO: 1775 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atgactagacactttttggctcc

SEQ ID NO: 1776 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
attgactagacactttttggctc

SEQ ID NO: 1777 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agttgactagacactttttggct

SEQ ID NO: 1778 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aagttgactagacactttttggc

SEQ ID NO: 1779 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaagttgactagacactttttgg

SEQ ID NO: 1780 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
ataagttgactagacactttttg

SEQ ID NO: 1781 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
attaagttgactagacacttttt

SEQ ID NO: 1782 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aattaagttgactagacactttt

SEQ ID NO: 1783 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaattaagttgactagacacttt

SEQ ID NO: 1784 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acaattaagttgactagacactt

SEQ ID NO: 1785 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atcaattaagttgactagacact

SEQ ID NO: 1786 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
actcaattaagttgactagacac

SEQ ID NO: 1787 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
accttctcaattaagttgactag

SEQ ID NO: 1788 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aacttgccaccttctcaattaag

SEQ ID NO: 1789 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaacttgccaccttctcaattaa

SEQ ID NO: 1790 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
accataacttgccaccttctcaa

SEQ ID NO: 1791 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaccataacttgccaccttctca

SEQ ID NO: 1792 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aacaccataacttgccaccttct

SEQ ID NO: 1793 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acacaccataacttgccaccttc

SEQ ID NO: 1794 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aggcttcacaccataacttgcca

SEQ ID NO: 1795 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atcttggcttcacaccataactt

SEQ ID NO: 1796 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aatatcttggcttcacaccataa

SEQ ID NO: 1797 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acatatcttggcttcacaccata

SEQ ID NO: 1798 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agacactttgacccaaattttgg

SEQ ID NO: 1799 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aagacactttgacccaaattttg

SEQ ID NO: 1800 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atcagacactttgacccaaattt

SEQ ID NO: 1801 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acgtgacccagtctgcattactg

SEQ ID NO: 1802 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atcgtgacccagtctgcattact

SEQ ID NO: 1803 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
attcgtgacccagtctgcattac

SEQ ID NO: 1804 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acttcgtgacccagtctgcatta

SEQ ID NO: 1805 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atcttcataattgatttcattga

SEQ ID NO: 1806 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aggtcttcataattgatttcatt

SEQ ID NO: 1807 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atgtggtcttcataattgatttc

SEQ ID NO: 1808 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
attgtggtcttcataattgattt

SEQ ID NO: 1809 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acttgtggtcttcataattgatt

SEQ ID NO: 1810 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aacttgtggtcttcataattgat

SEQ ID NO: 1811 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaacttgtggtcttcataattga

SEQ ID NO: 1812 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acaacttgtggtcttcataattg

SEQ ID NO: 1813 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atcaacttgtggtcttcataatt

SEQ ID NO: 1814 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
attcaacttgtggtcttcataat

SEQ ID NO: 1815 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acttcaacttgtggtcttcataa

SEQ ID NO: 1816 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aacttcaacttgtggtcttcata

SEQ ID NO: 1817 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agacttcaacttgtggtcttcat

SEQ ID NO: 1818 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atgacttcaacttgtggtcttca

SEQ ID NO: 1819 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
actgacttcaacttgtggtcttc

SEQ ID NO: 1820 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
accctgacttcaacttgtggtct

SEQ ID NO: 1821 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atccctgacttcaacttgtggtc

SEQ ID NO: 1822 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agtccctgacttcaacttgtggt

SEQ ID NO: 1823 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aagtccctgacttcaacttgtgg

SEQ ID NO: 1824 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
attagtccctgacttcaacttgt

SEQ ID NO: 1825 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agtgttagtccctgacttcaact

SEQ ID NO: 1826 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aggtgttagtccctgacttcaac

SEQ ID NO: 1827 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acttggtgttagtccctgacttc

SEQ ID NO: 1828 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atcttggtgttagtccctgactt

SEQ ID NO: 1829 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atcatgctgtacactgcctggag

SEQ ID NO: 1830 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aatcatgctgtacactgcctgga

SEQ ID NO: 1831 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acatcatgctgtacactgcctgg

SEQ ID NO: 1832 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
actcatcatgctgtacactgcct

SEQ ID NO: 1833 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acatgttgtgcaatccatcagtc

SEQ ID NO: 1834 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
accatgttgtgcaatccatcagt

SEQ ID NO: 1835 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acccatgttgtgcaatccatcag

SEQ ID NO: 1836 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agcccatgttgtgcaatccatca

SEQ ID NO: 1837 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acgcccatgttgtgcaatccatc

SEQ ID NO: 1838 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
accgcccatgttgtgcaatccat

SEQ ID NO: 1839 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atcaatgacagtaattgggtccc

SEQ ID NO: 1840 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aatcaatgacagtaattgggtcc

SEQ ID NO: 1841 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atcatcaatgacagtaattgggt

SEQ ID NO: 1842 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acccggatctcatcaatgacagt

SEQ ID NO: 1843 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atcccggatctcatcaatgacag

SEQ ID NO: 1844 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aagtcccggatctcatcaatgac

SEQ ID NO: 1845 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaagtcccggatctcatcaatga

SEQ ID NO: 1846 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agtttttgcgatccttgccaatg

SEQ ID NO: 1847 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aggtttttgcgatccttgccaat

SEQ ID NO: 1848 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agggtttttgcgatccttgccaa

SEQ ID NO: 1849 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aatccagataatcctcccttggg

SEQ ID NO: 1850 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atagacatccagataatcctccc

SEQ ID NO: 1851 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aatagacatccagataatcctcc

SEQ ID NO: 1852 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acatagacatccagataatcctc

SEQ ID NO: 1853 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aacatagacatccagataatcct

SEQ ID NO: 1854 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acacatagacatccagataatcc

SEQ ID NO: 1855 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aacacatagacatccagataatc

SEQ ID NO: 1856 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaacacatagacatccagataat

SEQ ID NO: 1857 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaaacacatagacatccagataa

SEQ ID NO: 1858 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acaaacacatagacatccagata

SEQ ID NO: 1859 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
accaaacacatagacatccagat

SEQ ID NO: 1860 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agcattgatgttcacttggttca

SEQ ID NO: 1861 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aagcattgatgttcacttggttc

SEQ ID NO: 1862 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaagcattgatgttcacttggtt

SEQ ID NO: 1863 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaaagcattgatgttcacttggt

SEQ ID NO: 1864 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
attggaagccaaagcattgatgt

SEQ ID NO: 1865 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acttggaagccaaagcattgatg

SEQ ID NO: 1866 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atcttggaagccaaagcattgat

SEQ ID NO: 1867 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aattgtctttcttggaagccaaa

SEQ ID NO: 1868 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agctcattgtctttcttggaagc

SEQ ID NO: 1869 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atgctcattgtctttcttggaag

SEQ ID NO: 1870 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agttgctcattgtctttcttgga

SEQ ID NO: 1871 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atgttgctcattgtctttcttgg

SEQ ID NO: 1872 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aacatgttgctcattgtctttct

SEQ ID NO: 1873 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aacacatgttgctcattgtcttt

SEQ ID NO: 1874 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaacacatgttgctcattgtctt

SEQ ID NO: 1875 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agaacacatgttgctcattgtct

SEQ ID NO: 1876 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atgaacacatgttgctcattgtc

SEQ ID NO: 1877 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atttgaacacatgttgctcattg

SEQ ID NO: 1878 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aactttgaacacatgttgctcat

SEQ ID NO: 1879 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agactttgaacacatgttgctca

SEQ ID NO: 1880 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
attgactttgaacacatgttgct

SEQ ID NO: 1881 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acttgactttgaacacatgttgc

SEQ ID NO: 1882 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
accttgactttgaacacatgttg

SEQ ID NO: 1883 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aatccttgactttgaacacatgt

SEQ ID NO: 1884 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atatccttgactttgaacacatg

SEQ ID NO: 1885 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aatatccttgactttgaacacat

SEQ ID NO: 1886 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atccatatccttgactttgaaca

SEQ ID NO: 1887 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
attccatatccttgactttgaac

SEQ ID NO: 1888 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atttccatatccttgactttgaa

SEQ ID NO: 1889 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agactcagagactggctttcatc

SEQ ID NO: 1890 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aagactcagagactggctttcat

SEQ ID NO: 1891 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaaccatgccacagagactcaga

SEQ ID NO: 1892 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acccaaaccatgccacagagact

SEQ ID NO: 1893 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atgttcccaaaccatgccacaga

SEQ ID NO: 1894 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atgtgttcccaaaccatgccaca

SEQ ID NO: 1895 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
attgtggtaatcggtacccttcc

SEQ ID NO: 1896 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agcttgtggtaatcggtaccctt

SEQ ID NO: 1897 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agttgcttgtggtaatcggtacc

SEQ ID NO: 1898 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atggttgcttgtggtaatcggta

SEQ ID NO: 1899 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aatggttgcttgtggtaatcggt

SEQ ID NO: 1900 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
accatggttgcttgtggtaatcg

SEQ ID NO: 1901 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agccatggttgcttgtggtaatc

SEQ ID NO: 1902 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atgccatggttgcttgtggtaat

SEQ ID NO: 1903 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
actgccatggttgcttgtggtaa

SEQ ID NO: 1904 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
attggcctgccatggttgcttgt

SEQ ID NO: 1905 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aagatcttggcctgccatggttg

SEQ ID NO: 1906 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agagatcttggcctgccatggtt

SEQ ID NO: 1907 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atgagatcttggcctgccatggt

SEQ ID NO: 1908 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaagtactcagacaccacagccc

SEQ ID NO: 1909 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaaagtactcagacaccacagcc

SEQ ID NO: 1910 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acaaagtactcagacaccacagc

SEQ ID NO: 1911 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aacaaagtactcagacaccacag

SEQ ID NO: 1912 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acacaaagtactcagacaccaca

SEQ ID NO: 1913 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaaacaatgtgctgctgtcagca

SEQ ID NO: 1914 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atctatctccaggtcccgcttct

SEQ ID NO: 1915 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
attctatctccaggtcccgcttc

SEQ ID NO: 1916 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaattcaggaattcctgcttctt

SEQ ID NO: 1917 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaaattcaggaattcctgcttct

SEQ ID NO: 1918 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
ataaaattcaggaattcctgctt

SEQ ID NO: 1919 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aataaaattcaggaattcctgct

SEQ ID NO: 1920 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acataaaattcaggaattcctgc

SEQ ID NO: 1921 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atcataaaattcaggaattcctg

SEQ ID NO: 1922 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agtcataaaattcaggaattcct

SEQ ID NO: 1923 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aagtcataaaattcaggaattcc

SEQ ID NO: 1924 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atagtcataaaattcaggaattc

SEQ ID NO: 1925 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aatagtcataaaattcaggaatt

SEQ ID NO: 1926 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acatagtcataaaattcaggaat

SEQ ID NO: 1927 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atcatagtcataaaattcaggaa

SEQ ID NO: 1928 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agtcatagtcataaaattcagga

SEQ ID NO: 1929 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aacgtcatagtcataaaattcag

SEQ ID NO: 1930 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaacgtcatagtcataaaattca

SEQ ID NO: 1931 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acaacgtcatagtcataaaattc

SEQ ID NO: 1932 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aggcaacgtcatagtcataaaat

SEQ ID NO: 1933 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agggcaacgtcatagtcataaaa

SEQ ID NO: 1934 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aagggcaacgtcatagtcataaa

SEQ ID NO: 1935 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acagggcaacgtcatagtcataa

SEQ ID NO: 1936 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atcagggcaacgtcatagtcata

SEQ ID NO: 1937 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aatcagggcaacgtcatagtcat

SEQ ID NO: 1938 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acttgatcagggcaacgtcatag

SEQ ID NO: 1939 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agcttgatcagggcaacgtcata

SEQ ID NO: 1940 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aagcttgatcagggcaacgtcat

SEQ ID NO: 1941 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agagcttgatcagggcaacgtca

SEQ ID NO: 1942 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
attgagcttgatcagggcaacgt

SEQ ID NO: 1943 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acttgagcttgatcagggcaacg

SEQ ID NO: 1944 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acaaatgggcctgatagtctggc

SEQ ID NO: 1945 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aacaaatgggcctgatagtctgg

SEQ ID NO: 1946 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agacaaatgggcctgatagtctg

SEQ ID NO: 1947 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aagacaaatgggcctgatagtct

SEQ ID NO: 1948 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agagacaaatgggcctgatagtc

SEQ ID NO: 1949 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaagctcgagttgttccctcggt

SEQ ID NO: 1950 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaaagctcgagttgttccctcgg

SEQ ID NO: 1951 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acaaagctcgagttgttccctcg

SEQ ID NO: 1952 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acctcaaagctcgagttgttccc

SEQ ID NO: 1953 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agcctcaaagctcgagttgttcc

SEQ ID NO: 1954 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaagcctcaaagctcgagttgtt

SEQ ID NO: 1955 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agaagcctcaaagctcgagttgt

SEQ ID NO: 1956 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aggaagcctcaaagctcgagttg

SEQ ID NO: 1957 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atggaggaagcctcaaagctcga

SEQ ID NO: 1958 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
attggaggaagcctcaaagctcg

SEQ ID NO: 1959 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agttggaggaagcctcaaagctc

SEQ ID NO: 1960 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aagttggaggaagcctcaaagct

SEQ ID NO: 1961 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atagttggaggaagcctcaaagc

SEQ ID NO: 1962 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atggtagttggaggaagcctcaa

SEQ ID NO: 1963 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agtggtagttggaggaagcctca

SEQ ID NO: 1964 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaagtggtagttggaggaagcct

SEQ ID NO: 1965 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agcaagtggtagttggaggaagc

SEQ ID NO: 1966 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aggcaagtggtagttggaggaag

SEQ ID NO: 1967 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
attgctggcaagtggtagttgga

SEQ ID NO: 1968 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atgttgctggcaagtggtagttg

SEQ ID NO: 1969 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
attgatatcctgtgcagggagca

SEQ ID NO: 1970 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atttgatatcctgtgcagggagc

SEQ ID NO: 1971 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
actttgatatcctgtgcagggag

SEQ ID NO: 1972 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aagctttgatatcctgtgcaggg

SEQ ID NO: 1973 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaacagagctttgatatcctgtg

SEQ ID NO: 1974 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aacaaacagagctttgatatcct

SEQ ID NO: 1975 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atcagacacaaacagagctttga

SEQ ID NO: 1976 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aagacctccttccgagtcagctt

SEQ ID NO: 1977 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atagacctccttccgagtcagct

SEQ ID NO: 1978 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aatgtagacctccttccgagtca

SEQ ID NO: 1979 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atgatgtagacctccttccgagt

SEQ ID NO: 1980 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
attgatgtagacctccttccgag

SEQ ID NO: 1981 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
attcttgatgtagacctccttcc

SEQ ID NO: 1982 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aattcttgatgtagacctccttc

SEQ ID NO: 1983 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
actctcacagctgcctttcttat

SEQ ID NO: 1984 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atctctctcacagctgcctttct

SEQ ID NO: 1985 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atgagcatctctctcacagctgc

SEQ ID NO: 1986 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aattgagcatctctctcacagct

SEQ ID NO: 1987 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atattgagcatctctctcacagc

SEQ ID NO: 1988 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aatattgagcatctctctcacag

SEQ ID NO: 1989 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acatattgagcatctctctcaca

SEQ ID NO: 1990 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agcatattgagcatctctctcac

SEQ ID NO: 1991 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acttgactttgtcatagcctggg

SEQ ID NO: 1992 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
accttgactttgtcatagcctgg

SEQ ID NO: 1993 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atccttgactttgtcatagcctg

SEQ ID NO: 1994 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agagatgtccttgactttgtcat

SEQ ID NO: 1995 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
actccagtacaaaggaaccgagg

SEQ ID NO: 1996 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acctccagtacaaaggaaccgag

SEQ ID NO: 1997 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atcctccagtacaaaggaaccga

SEQ ID NO: 1998 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aactcctccagtacaaaggaacc

SEQ ID NO: 1999 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atcactcctccagtacaaaggaa

SEQ ID NO: 2000 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agactcactcctccagtacaaag

SEQ ID NO: 2001 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aggactcactcctccagtacaaa

SEQ ID NO: 2002 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agggactcactcctccagtacaa

SEQ ID NO: 2003 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atagggactcactcctccagtac

SEQ ID NO: 2004 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acatagggactcactcctccagt

SEQ ID NO: 2005 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aagcatagggactcactcctcca

SEQ ID NO: 2006 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atcagcatagggactcactcctc

SEQ ID NO: 2007 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agtcagcatagggactcactcct

SEQ ID NO: 2008 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaatcacctctgcaagtattggg

SEQ ID NO: 2009 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agaatcacctctgcaagtattgg

SEQ ID NO: 2010 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acagaatcacctctgcaagtatt

SEQ ID NO: 2011 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agccagaatcacctctgcaagta

SEQ ID NO: 2012 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acgccagaatcacctctgcaagt

SEQ ID NO: 2013 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aacttctcttgtgaactatcaag

SEQ ID NO: 2014 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agacttctcttgtgaactatcaa

SEQ ID NO: 2015 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acgacttctcttgtgaactatca

SEQ ID NO: 2016 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aacgacttctcttgtgaactatc

SEQ ID NO: 2017 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaacgacttctcttgtgaactat

SEQ ID NO: 2018 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaaacgacttctcttgtgaacta

SEQ ID NO: 2019 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agaaacgacttctcttgtgaact

SEQ ID NO: 2020 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atgaaacgacttctcttgtgaac

SEQ ID NO: 2021 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aatgaaacgacttctcttgtgaa

SEQ ID NO: 2022 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaatgaaacgacttctcttgtga

SEQ ID NO: 2023 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agaatgaaacgacttctcttgtg

SEQ ID NO: 2024 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atgaatgaaacgacttctcttgt

SEQ ID NO: 2025 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
attgaatgaaacgacttctcttg

SEQ ID NO: 2026 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acttgaatgaaacgacttctctt

SEQ ID NO: 2027 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aacttgaatgaaacgacttctct

SEQ ID NO: 2028 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaacttgaatgaaacgacttctc

SEQ ID NO: 2029 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acaacttgaatgaaacgacttct

SEQ ID NO: 2030 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
accaacttgaatgaaacgacttc

SEQ ID NO: 2031 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atttgcagacatccactactccc

SEQ ID NO: 2032 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
attttgcagacatccactactcc

SEQ ID NO: 2033 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atttttgcagacatccactactc

SEQ ID NO: 2034 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agtttttgcagacatccactact

SEQ ID NO: 2035 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aggtttttgcagacatccactac

SEQ ID NO: 2036 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atggtttttgcagacatccacta

SEQ ID NO: 2037 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
actggtttttgcagacatccact

SEQ ID NO: 2038 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-O-methyladenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atctggtttttgcagacatccac

SEQ ID NO: 2039 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methylguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
attctggtttttgcagacatcca

SEQ ID NO: 2040 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acgcttctggtttttgcagacat

SEQ ID NO: 2041 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
accgcttctggtttttgcagaca

SEQ ID NO: 2042 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agccgcttctggtttttgcagac

SEQ ID NO: 2043 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atttgccgcttctggtttttgca

SEQ ID NO: 2044 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-O-methylguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
attttgccgcttctggtttttgc

SEQ ID NO: 2045 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acttttgccgcttctggtttttg

SEQ ID NO: 2046 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agcttttgccgcttctggttttt

SEQ ID NO: 2047 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atgcttttgccgcttctggtttt

SEQ ID NO: 2048 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-O-methylguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atacctgcttttgccgcttctgg

SEQ ID NO: 2049 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acgtgagcaggtacctgcttttg

SEQ ID NO: 2050 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
attcagccagggcagcacttgaa

SEQ ID NO: 2051 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atggagtttctccttcagccagg

SEQ ID NO: 2052 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methylguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acaaatcctcatcttggagtttc

SEQ ID NO: 2053 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-O-methylcytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aacccaaatcctcatcttggagt

SEQ ID NO: 2054 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aaaacccaaatcctcatcttgga

SEQ ID NO: 2055 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agaaaacccaaatcctcatcttg

SEQ ID NO: 2056 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
actgttttaattcaatcccacgc

SEQ ID NO: 2057 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methylguanosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agctgttttaattcaatcccacg

SEQ ID NO: 2058 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
aagctgttttaattcaatcccac

SEQ ID NO: 2059 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxycytidine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 6: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-O-methyluridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
acgcagctgttttaattcaatcc

SEQ ID NO: 2060 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 6: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-O-methyladenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atcgcagctgttttaattcaatc

SEQ ID NO: 2061 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxyguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methyladenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
agtcgcagctgttttaattcaat

SEQ ID NO: 2062 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-deoxythymidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-O-methyluridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1: note = RNA
  misc_feature 2: note = DNA
  misc_feature 3..4: note = RNA
  misc_feature 5: note = DNA
  misc_feature 6: note = RNA
  misc_feature 7: note = DNA
  misc_feature 8..11: note = RNA
  misc_feature 12: note = DNA
  misc_feature 13..23: note = RNA
atgtcgcagctgttttaattcaa

SEQ ID NO: 2063 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
aagggtacgggtagaagccagaa

SEQ ID NO: 2064 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
atcactcacattgtagtagggag

SEQ ID NO: 2065 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
aatcactcacattgtagtaggga

SEQ ID NO: 2066 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
actcatcactcacattgtagtag

SEQ ID NO: 2067 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
agatctcatcactcacattgtag

SEQ ID NO: 2068 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
aagatctcatcactcacattgta

SEQ ID NO: 2069 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
agagatctcatcactcacattgt

SEQ ID NO: 2070 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
aagagatctcatcactcacattg

SEQ ID NO: 2071 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
aaagagatctcatcactcacatt

SEQ ID NO: 2072 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
aaaagagatctcatcactcacat

SEQ ID NO: 2073 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
agaaagagatctcatcactcaca

SEQ ID NO: 2074 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
aggaaagagatctcatcactcac

SEQ ID NO: 2075 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
atggaaagagatctcatcactca

SEQ ID NO: 2076 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
aagtggaaagagatctcatcact

SEQ ID NO: 2077 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
agtcatagcagtggaaagagatc

SEQ ID NO: 2078 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
aagtgtaaccgtcatagcagtgg

SEQ ID NO: 2079 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
attgtcacagatcgctgtctgcc

SEQ ID NO: 2080 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
ataggtgacgctgtcttcaaggc

SEQ ID NO: 2081 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
agtcgtacatgaaggagtcttgg

SEQ ID NO: 2082 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
agtgtcgtacatgaaggagtctt

SEQ ID NO: 2083 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
acgactccttctatggtctctgt

SEQ ID NO: 2084 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
aatcgactccttctatggtctct

SEQ ID NO: 2085 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
acatcgactccttctatggtctc

SEQ ID NO: 2086 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
atagcaccaggtagatgttcatg

SEQ ID NO: 2087 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
agtctgatccatctagcaccagg

SEQ ID NO: 2088 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
actgtctgatccatctagcacca

SEQ ID NO: 2089 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
attttggctcctgtgaagttgct

SEQ ID NO: 2090 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
atttttggctcctgtgaagttgc

SEQ ID NO: 2091 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
aactttttggctcctgtgaagtt

SEQ ID NO: 2092 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
aactagacactttttggctcctg

SEQ ID NO: 2093 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
agactagacactttttggctcct

SEQ ID NO: 2094 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
attgactagacactttttggctc

SEQ ID NO: 2095 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
agttgactagacactttttggct

SEQ ID NO: 2096 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
aagttgactagacactttttggc

SEQ ID NO: 2097 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
aaagttgactagacactttttgg

SEQ ID NO: 2098 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
ataagttgactagacactttttg

SEQ ID NO: 2099 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
attaagttgactagacacttttt

SEQ ID NO: 2100 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
actcaattaagttgactagacac

SEQ ID NO: 2101 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
aacttgccaccttctcaattaag

SEQ ID NO: 2102 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
aacaccataacttgccaccttct

SEQ ID NO: 2103 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
aggcttcacaccataacttgcca

SEQ ID NO: 2104 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
aatatcttggcttcacaccataa

SEQ ID NO: 2105 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
agacactttgacccaaattttgg

SEQ ID NO: 2106 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
aagacactttgacccaaattttg

SEQ ID NO: 2107 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
atcagacactttgacccaaattt

SEQ ID NO: 2108 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
acgtgacccagtctgcattactg

SEQ ID NO: 2109 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
atcttcataattgatttcattga

SEQ ID NO: 2110 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
acttgtggtcttcataattgatt

SEQ ID NO: 2111 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
aacttgtggtcttcataattgat

SEQ ID NO: 2112 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
acaacttgtggtcttcataattg

SEQ ID NO: 2113 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
atcaacttgtggtcttcataatt

SEQ ID NO: 2114 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
attcaacttgtggtcttcataat

SEQ ID NO: 2115 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
acttcaacttgtggtcttcataa

SEQ ID NO: 2116 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
aacttcaacttgtggtcttcata

SEQ ID NO: 2117 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
agacttcaacttgtggtcttcat

SEQ ID NO: 2118 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
atgacttcaacttgtggtcttca

SEQ ID NO: 2119 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-fluorocytidine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
agtccctgacttcaacttgtggt

SEQ ID NO: 2120 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluorocytidine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
aagtccctgacttcaacttgtgg

SEQ ID NO: 2121 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
acatcatgctgtacactgcctgg

SEQ ID NO: 2122 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
actcatcatgctgtacactgcct

SEQ ID NO: 2123 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
acccatgttgtgcaatccatcag

SEQ ID NO: 2124 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
agcccatgttgtgcaatccatca

SEQ ID NO: 2125 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-fluorocytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
accgcccatgttgtgcaatccat

SEQ ID NO: 2126 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
atcaatgacagtaattgggtccc

SEQ ID NO: 2127 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
aatcaatgacagtaattgggtcc

SEQ ID NO: 2128 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
atcatcaatgacagtaattgggt

SEQ ID NO: 2129 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
aaagtcccggatctcatcaatga

SEQ ID NO: 2130 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
agtttttgcgatccttgccaatg

SEQ ID NO: 2131 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
aatccagataatcctcccttggg

SEQ ID NO: 2132 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
atagacatccagataatcctccc

SEQ ID NO: 2133 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
aatagacatccagataatcctcc

SEQ ID NO: 2134 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
acatagacatccagataatcctc

SEQ ID NO: 2135 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
aacatagacatccagataatcct

SEQ ID NO: 2136 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
acacatagacatccagataatcc

SEQ ID NO: 2137 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
aacacatagacatccagataatc

SEQ ID NO: 2138 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
aaacacatagacatccagataat

SEQ ID NO: 2139 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
aaaacacatagacatccagataa

SEQ ID NO: 2140 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
acaaacacatagacatccagata

SEQ ID NO: 2141 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
agcattgatgttcacttggttca

SEQ ID NO: 2142 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
aagcattgatgttcacttggttc

SEQ ID NO: 2143 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
aaagcattgatgttcacttggtt

SEQ ID NO: 2144 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
aaaagcattgatgttcacttggt

SEQ ID NO: 2145 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
attggaagccaaagcattgatgt

SEQ ID NO: 2146 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
atcttggaagccaaagcattgat

SEQ ID NO: 2147 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
aattgtctttcttggaagccaaa

SEQ ID NO: 2148 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
agctcattgtctttcttggaagc

SEQ ID NO: 2149 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
atgctcattgtctttcttggaag

SEQ ID NO: 2150 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
atgttgctcattgtctttcttgg

SEQ ID NO: 2151 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
aacatgttgctcattgtctttct

SEQ ID NO: 2152 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
aacacatgttgctcattgtcttt

SEQ ID NO: 2153 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
aaacacatgttgctcattgtctt

SEQ ID NO: 2154 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
agaacacatgttgctcattgtct

SEQ ID NO: 2155 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
atgaacacatgttgctcattgtc

SEQ ID NO: 2156 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
atttgaacacatgttgctcattg

SEQ ID NO: 2157 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
aactttgaacacatgttgctcat

SEQ ID NO: 2158 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
attgactttgaacacatgttgct

SEQ ID NO: 2159 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
acttgactttgaacacatgttgc

SEQ ID NO: 2160 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
accttgactttgaacacatgttg

SEQ ID NO: 2161 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
aatccttgactttgaacacatgt

SEQ ID NO: 2162 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluorocytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
atatccttgactttgaacacatg

SEQ ID NO: 2163 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
aatatccttgactttgaacacat

SEQ ID NO: 2164 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
atccatatccttgactttgaaca

SEQ ID NO: 2165 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
attccatatccttgactttgaac

SEQ ID NO: 2166 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluorocytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
agttgcttgtggtaatcggtacc

SEQ ID NO: 2167 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
atggttgcttgtggtaatcggta

SEQ ID NO: 2168 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methylguanosine-3'-phosphate
accatggttgcttgtggtaatcg

SEQ ID NO: 2169 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
actgccatggttgcttgtggtaa

SEQ ID NO: 2170 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
acacaaagtactcagacaccaca

SEQ ID NO: 2171 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
aaattcaggaattcctgcttctt

SEQ ID NO: 2172 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
aaaattcaggaattcctgcttct

SEQ ID NO: 2173 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
ataaaattcaggaattcctgctt

SEQ ID NO: 2174 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
aataaaattcaggaattcctgct

SEQ ID NO: 2175 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
agtcataaaattcaggaattcct

SEQ ID NO: 2176 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
aagtcataaaattcaggaattcc

SEQ ID NO: 2177 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
atagtcataaaattcaggaattc

SEQ ID NO: 2178 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
aatagtcataaaattcaggaatt

SEQ ID NO: 2179 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
atcatagtcataaaattcaggaa

SEQ ID NO: 2180 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
agtcatagtcataaaattcagga

SEQ ID NO: 2181 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
aacgtcatagtcataaaattcag

SEQ ID NO: 2182 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
aaacgtcatagtcataaaattca

SEQ ID NO: 2183 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluoroguanosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
acaacgtcatagtcataaaattc

SEQ ID NO: 2184 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
aggcaacgtcatagtcataaaat

SEQ ID NO: 2185 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylguanosine-3'-phosphate
  modified_base 6: mod_base = OTHER; note = 2'-fluoroguanosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
acagggcaacgtcatagtcataa

SEQ ID NO: 2186 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
acaaatgggcctgatagtctggc

SEQ ID NO: 2187 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methyladenosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
aacaaatgggcctgatagtctgg

SEQ ID NO: 2188 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
aaagctcgagttgttccctcggt

SEQ ID NO: 2189 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluorocytidine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
aaaagctcgagttgttccctcgg

SEQ ID NO: 2190 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
agcctcaaagctcgagttgttcc

SEQ ID NO: 2191 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
aaagtggtagttggaggaagcct

SEQ ID NO: 2192 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
aagctttgatatcctgtgcaggg

SEQ ID NO: 2193 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
aaacagagctttgatatcctgtg

SEQ ID NO: 2194 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
aacaaacagagctttgatatcct

SEQ ID NO: 2195 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
atcagacacaaacagagctttga

SEQ ID NO: 2196 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
actctcacagctgcctttcttat

SEQ ID NO: 2197 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylguanosine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
atgagcatctctctcacagctgc

SEQ ID NO: 2198 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
aattgagcatctctctcacagct

SEQ ID NO: 2199 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
atattgagcatctctctcacagc

SEQ ID NO: 2200 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
aatattgagcatctctctcacag

SEQ ID NO: 2201 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
acatattgagcatctctctcaca

SEQ ID NO: 2202 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
agcatattgagcatctctctcac

SEQ ID NO: 2203 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
acttgactttgtcatagcctggg

SEQ ID NO: 2204 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
atccttgactttgtcatagcctg

SEQ ID NO: 2205 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
agagatgtccttgactttgtcat

SEQ ID NO: 2206 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
agactcactcctccagtacaaag

SEQ ID NO: 2207 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
agaatcacctctgcaagtattgg

SEQ ID NO: 2208 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
acagaatcacctctgcaagtatt

SEQ ID NO: 2209 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluorocytidine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methylguanosine-3'-phosphate
aacttctcttgtgaactatcaag

SEQ ID NO: 2210 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
agacttctcttgtgaactatcaa

SEQ ID NO: 2211 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
acgacttctcttgtgaactatca

SEQ ID NO: 2212 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
aacgacttctcttgtgaactatc

SEQ ID NO: 2213 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
aaacgacttctcttgtgaactat

SEQ ID NO: 2214 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
aaaacgacttctcttgtgaacta

SEQ ID NO: 2215 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
agaaacgacttctcttgtgaact

SEQ ID NO: 2216 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
atgaaacgacttctcttgtgaac

SEQ ID NO: 2217 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
aatgaaacgacttctcttgtgaa

SEQ ID NO: 2218 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylguanosine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
aaatgaaacgacttctcttgtga

SEQ ID NO: 2219 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
agaatgaaacgacttctcttgtg

SEQ ID NO: 2220 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
atgaatgaaacgacttctcttgt

SEQ ID NO: 2221 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
acttgaatgaaacgacttctctt

SEQ ID NO: 2222 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluorocytidine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
aacttgaatgaaacgacttctct

SEQ ID NO: 2223 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
aaacttgaatgaaacgacttctc

SEQ ID NO: 2224 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
acaacttgaatgaaacgacttct

SEQ ID NO: 2225 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluorocytidine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methylguanosine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
accaacttgaatgaaacgacttc

SEQ ID NO: 2226 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluorocytidine-3'-phosphate
  modified_base 7: mod_base = OTHER; note = 2'-O-methyladenosine-3'-phosphate
  modified_base 8: mod_base = OTHER; note = 2'-O-methylguanosine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
atttgcagacatccactactccc

SEQ ID NO: 2227 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
attttgcagacatccactactcc

SEQ ID NO: 2228 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methyladenosine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorocytidine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
atttttgcagacatccactactc

SEQ ID NO: 2229 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyluridine-3'-phosphate
agtttttgcagacatccactact

SEQ ID NO: 2230 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluoroguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylguanosine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
atctggtttttgcagacatccac

SEQ ID NO: 2231 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 7: mod_base = OTHER; note = 2'-O-methylguanosine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyluridine-3'-phosphate
  modified_base 21: mod_base = OTHER; note = 2'-O-methylcytidine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
attctggtttttgcagacatcca

SEQ ID NO: 2232 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methyluridine-3'-phosphate
acgcttctggtttttgcagacat

SEQ ID NO: 2233 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
accgcttctggtttttgcagaca

SEQ ID NO: 2234 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluoroguanosine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
attttgccgcttctggtttttgc

SEQ ID NO: 2235 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
acttttgccgcttctggtttttg

SEQ ID NO: 2236 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylguanosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
atgcttttgccgcttctggtttt

SEQ ID NO: 2237 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methyladenosine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-fluorouridine-3'-phosphate
  modified_base 7: mod_base = OTHER; note = 2'-O-methylguanosine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluoroguanosine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
atacctgcttttgccgcttctgg

SEQ ID NO: 2238 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluorouridine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methyluridine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylcytidine-3'-phosphate
acaaatcctcatcttggagtttc

SEQ ID NO: 2239 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylcytidine-3'-phosphate
  modified_base 5: mod_base = OTHER; note = 2'-O-methylcytidine-3'-phosphate
  modified_base 6: mod_base = OTHER; note = 2'-fluoroadenosine-3'-phosphate
  modified_base 7: mod_base = OTHER; note = 2'-O-methyladenosine-3'-phosphate
  modified_base 8: mod_base = OTHER; note = 2'-O-methyladenosine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methylcytidine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methylguanosine-3'- phosphorothioate
  modified_base 23: mod_base = OTHER; note = 2'-O-methyluridine-3'-phosphate
aacccaaatcctcatcttggagt

SEQ ID NO: 2240 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methylcytidine-3'-phosphate
  modified_base 6: mod_base = OTHER; note = 2'-fluorocytidine-3'-phosphate
  modified_base 7: mod_base = OTHER; note = 2'-O-methylcytidine-3'-phosphate
  modified_base 8: mod_base = OTHER; note = 2'-O-methyladenosine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methylcytidine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
aaaacccaaatcctcatcttgga

SEQ ID NO: 2241 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 5: mod_base = OTHER; note = 2'-O-methyladenosine-3'-phosphate
  modified_base 6: mod_base = OTHER; note = 2'-fluoroadenosine-3'-phosphate
  modified_base 7: mod_base = OTHER; note = 2'-O-methylcytidine-3'-phosphate
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
agaaaacccaaatcctcatcttg

SEQ ID NO: 2242 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methyluridine-3'-phosphate
  modified_base 4: mod_base = OTHER; note = 2'-O-methylguanosine-3'-phosphate
  modified_base 5: mod_base = OTHER; note = 2'-O-methyluridine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyladenosine-3'-phosphate
  modified_base 10: mod_base = OTHER; note = 2'-O-methyladenosine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylcytidine-3'- phosphorothioate
  modified_base 22: mod_base = OTHER; note = 2'-O-methylguanosine-3'- phosphorothioate
  modified_base 23: mod_base = OTHER; note = 2'-O-methylcytidine-3'-phosphate
actgttttaattcaatcccacgc

SEQ ID NO: 2243 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 5: mod_base = OTHER; note = 2'-O-methylguanosine-3'-phosphate
  modified_base 6: mod_base = OTHER; note = 2'-fluorouridine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methylguanosine-3'-phosphate
agctgttttaattcaatcccacg

SEQ ID NO: 2244 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyluridine-3'-phosphate
  modified_base 6: mod_base = OTHER; note = 2'-fluoroguanosine-3'-phosphate
  modified_base 7: mod_base = OTHER; note = 2'-O-methyluridine-3'-phosphate
  modified_base 8: mod_base = OTHER; note = 2'-O-methyluridine-3'-phosphate
  modified_base 9: mod_base = OTHER; note = 2'-O-methyluridine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methyladenosine-3'-phosphate
  modified_base 18: mod_base = OTHER; note = 2'-O-methyluridine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methylcytidine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
aagctgttttaattcaatcccac

SEQ ID NO: 2245 - RNA, 23 nt, synthetic construct
  source 1..23: mol_type = other RNA
  modified_base 1: mod_base = OTHER; note = 2'-O-methyladenosine-3'- phosphorothioate
  modified_base 2: mod_base = OTHER; note = 2'-fluorocytidine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-fluoroguanosine-3'-phosphate
  modified_base 7: mod_base = OTHER; note = 2'-O-methylcytidine-3'-phosphate
  modified_base 8: mod_base = OTHER; note = 2'-O-methyluridine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyluridine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorouridine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
acgcagctgttttaattcaatcc

SEQ ID NO: 2246 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methyluridine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aagacctggtcacattcccttcc

SEQ ID NO: 2247 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyladenosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methylcytidine-3'-phosphate
  modified_base 10: mod_base = OTHER; note = 2'-O-methyladenosine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methylcytidine-3'-phosphate
  modified_base 21: mod_base = OTHER; note = 2'-O-methyluridine-3'-phosphorothioate
  modified_base 22: mod_base = OTHER; note = 2'-O-methylguanosine-3'- phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
agaaactccagacctagacctgg

SEQ ID NO: 2248 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroguanosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methyladenosine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylguanosine-3'-phosphate
  modified_base 12: mod_base = OTHER; note = 2'-O-methyladenosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
agtccaagctgaaactccagacc

SEQ ID NO: 2249 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylguanosine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methylcytidine-3'-phosphate
  modified_base 11: mod_base = OTHER; note = 2'-O-methyluridine-3'-phosphate
  modified_base 12: mod_base = OTHER; note = 2'-O-methylguanosine-3'-phosphate
  modified_base 13: mod_base = OTHER; note = 2'-O-methyladenosine-3'-phosphate
  modified_base 14: mod_base = OTHER; note = 2'-fluoroadenosine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methylcytidine-3'-phosphate
  misc_feature 1..4: note = RNA
  misc_feature 5: note = DNA
  misc_feature 6..23: note = RNA
atgtccaagctgaaactccagac

SEQ ID NO: 2250 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylcytidine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Thymidine-glycol nucleic acid (GNA) S-Isomer
  modified_base 8: mod_base = OTHER; note = 2'-O-methyladenosine-3'-phosphate
  modified_base 9: mod_base = OTHER; note = 2'-O-methylguanosine-3'-phosphate
  modified_base 10: mod_base = OTHER; note = 2'-O-methyladenosine-3'-phosphate
  modified_base 11: mod_base = OTHER; note = 2'-O-methyladenosine-3'-phosphate
  modified_base 12: mod_base = OTHER; note = 2'-O-methylguanosine-3'-phosphate
  modified_base 13: mod_base = OTHER; note = 2'-O-methylcytidine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluoroguanosine-3'-phosphate
  modified_base 17: mod_base = OTHER; note = 2'-O-methyladenosine-3'-phosphate
  modified_base 18: mod_base = OTHER; note = 2'-O-methyladenosine-3'-phosphate
  modified_base 19: mod_base = OTHER; note = 2'-O-methylguanosine-3'-phosphate
  modified_base 20: mod_base = OTHER; note = 2'-O-methylguanosine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aacgggtagaagccagaaggaca

SEQ ID NO: 2251 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methylguanosine-3'-phosphate
  modified_base 6: mod_base = OTHER; note = 2'-O-methyluridine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methylguanosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methyluridine-3'-phosphate
  modified_base 13: mod_base = OTHER; note = 2'-O-methyladenosine-3'-phosphate
  modified_base 14: mod_base = OTHER; note = 2'-fluoroguanosine-3'-phosphate
  modified_base 15: mod_base = OTHER; note = 2'-O-methyladenosine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
aagggtacgggtagaagccagaa

SEQ ID NO: 2252 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylguanosine-3'-phosphate
  modified_base 11: mod_base = OTHER; note = 2'-O-methylguanosine-3'-phosphate
  modified_base 12: mod_base = OTHER; note = 2'-O-methylguanosine-3'-phosphate
  modified_base 13: mod_base = OTHER; note = 2'-O-methyluridine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluoroguanosine-3'-phosphate
  modified_base 17: mod_base = OTHER; note = 2'-O-methylguanosine-3'-phosphate
  modified_base 18: mod_base = OTHER; note = 2'-O-methylguanosine-3'-phosphate
  modified_base 19: mod_base = OTHER; note = 2'-O-methyluridine-3'-phosphate
  modified_base 20: mod_base = OTHER; note = 2'-O-methyladenosine-3'-phosphate
  modified_base 21: mod_base = OTHER; note = 2'-O-methylguanosine-3'- phosphorothioate
  modified_base 22: mod_base = OTHER; note = 2'-O-methyladenosine-3'- phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
atctgcacagggtacgggtagaa

SEQ ID NO: 2253 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluorouridine -3'-phosphorothioate
  modified_base 3: mod_base = OTHER; note = 2'-O-methylcytidine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Adenosine-glycol nucleic acid (GNA) S-Isomer
  modified_base 8: mod_base = OTHER; note = 2'-O-methylguanosine-3'-phosphate
  modified_base 9: mod_base = OTHER; note = 2'-O-methylguanosine-3'-phosphate
  modified_base 10: mod_base = OTHER; note = 2'-O-methyluridine-3'-phosphate
  modified_base 11: mod_base = OTHER; note = 2'-O-methyladenosine-3'-phosphate
  modified_base 12: mod_base = OTHER; note = 2'-O-methylcytidine-3'-phosphate
  modified_base 13: mod_base = OTHER; note = 2'-O-methylguanosine-3'-phosphate
  modified_base 14: mod_base = OTHER; note = 2'-fluorouridine-3'-phosphate
  modified_base 15: mod_base = OTHER; note = 2'-O-methylguanosine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyluridine-3'-phosphate
  modified_base 19: mod_base = OTHER; note = 2'-O-methylguanosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methylcytidine-3'- phosphorothioate
  modified_base 23: mod_base = OTHER; note = 2'-O-methyladenosine-3'-phosphate
  misc_feature 1..4: note = RNA
  misc_feature 5: note = DNA
  misc_feature 6..23: note = RNA
atctgcaggtacgtgtctgcaca

SEQ ID NO: 2254 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methyluridine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylguanosine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylcytidine-3'-phosphate
  modified_base 20: mod_base = OTHER; note = 2'-O-methyluridine-3'-phosphate
  modified_base 21: mod_base = OTHER; note = 2'-O-methyluridine-3'-phosphorothioate
  modified_base 22: mod_base = OTHER; note = 2'-O-methylcytidine-3'- phosphorothioate
  modified_base 23: mod_base = OTHER; note = 2'-O-methylcytidine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aattgctctgcactctgccttcc

SEQ ID NO: 2255 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyluridine-3'-phosphate
  modified_base 4: mod_base = OTHER; note = 2'-O-methylcytidine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methyluridine-3'-phosphate
  modified_base 14: mod_base = OTHER; note = 2'-fluoroguanosine-3'-phosphate
  modified_base 15: mod_base = OTHER; note = 2'-O-methyluridine-3'-phosphate
  modified_base 16: mod_base = OTHER; note = 2'-fluoroadenosine-3'-phosphate
  modified_base 17: mod_base = OTHER; note = 2'-O-methylguanosine-3'-phosphate
  modified_base 18: mod_base = OTHER; note = 2'-O-methyluridine-3'-phosphate
  modified_base 19: mod_base = OTHER; note = 2'-O-methyladenosine-3'-phosphate
  modified_base 20: mod_base = OTHER; note = 2'-O-methylguanosine-3'-phosphate
  modified_base 21: mod_base = OTHER; note = 2'-O-methylguanosine-3'- phosphorothioate
  modified_base 22: mod_base = OTHER; note = 2'-O-methylguanosine-3'- phosphorothioate
  modified_base 23: mod_base = OTHER; note = 2'-O-methyladenosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aatcactcacattgtagtaggga

SEQ ID NO: 2256 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methylcytidine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyladenosine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methylcytidine-3'-phosphate
  modified_base 14: mod_base = OTHER; note = 2'-fluorouridine-3'-phosphate
  modified_base 15: mod_base = OTHER; note = 2'-O-methylcytidine-3'-phosphate
  modified_base 16: mod_base = OTHER; note = 2'-fluoroadenosine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methyluridine-3'-phosphate
  modified_base 20: mod_base = OTHER; note = 2'-O-methyluridine-3'-phosphate
  modified_base 21: mod_base = OTHER; note = 2'-O-methylguanosine-3'- phosphorothioate
  modified_base 22: mod_base = OTHER; note = 2'-O-methyluridine-3'-phosphorothioate
  modified_base 23: mod_base = OTHER; note = 2'-O-methyladenosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aagatctcatcactcacattgta

SEQ ID NO: 2257 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methylguanosine-3'-phosphate
  modified_base 4: mod_base = OTHER; note = 2'-O-methyladenosine-3'-phosphate
  modified_base 6: mod_base = OTHER; note = 2'-O-methyladenosine-3'-phosphate
  modified_base 7: mod_base = OTHER; note = Thymidine-glycol nucleic acid (GNA) S-Isomer
  modified_base 8: mod_base = OTHER; note = 2'-O-methylcytidine-3'-phosphate
  modified_base 9: mod_base = OTHER; note = 2'-O-methyluridine-3'-phosphate
  modified_base 10: mod_base = OTHER; note = 2'-O-methylcytidine-3'-phosphate
  modified_base 11: mod_base = OTHER; note = 2'-O-methyladenosine-3'-phosphate
  modified_base 12: mod_base = OTHER; note = 2'-O-methyluridine-3'-phosphate
  modified_base 13: mod_base = OTHER; note = 2'-O-methylcytidine-3'-phosphate
  modified_base 14: mod_base = OTHER; note = 2'-fluoroadenosine-3'-phosphate
  modified_base 15: mod_base = OTHER; note = 2'-O-methylcytidine-3'-phosphate
  modified_base 16: mod_base = OTHER; note = 2'-fluorouridine-3'-phosphate
  modified_base 17: mod_base = OTHER; note = 2'-O-methylcytidine-3'-phosphate
  modified_base 18: mod_base = OTHER; note = 2'-O-methyladenosine-3'-phosphate
  modified_base 19: mod_base = OTHER; note = 2'-O-methylcytidine-3'-phosphate
  modified_base 20: mod_base = OTHER; note = 2'-O-methyladenosine-3'-phosphate
  modified_base 21: mod_base = OTHER; note = 2'-O-methyluridine-3'-phosphorothioate
  modified_base 22: mod_base = OTHER; note = 2'-O-methyluridine-3'-phosphorothioate
  modified_base 23: mod_base = OTHER; note = 2'-O-methylguanosine-3'-phosphate
  misc_feature 1..4: note = RNA
  misc_feature 5: note = DNA
  misc_feature 6: note = RNA
  misc_feature 7: note = DNA
  misc_feature 8..23: note = RNA
aagagatctcatcactcacattg

SEQ ID NO: 2258 - DNA, 23 bp, synthetic construct
  source 1..23: mol_type = other DNA
  modified_base 1: mod_base = OTHER; note = 2'-O-methyladenosine-3'- phosphorothioate
  modified_base 2: mod_base = OTHER; note = 2'-fluoroadenosine-3'-phosphorothioate
  modified_base 3: mod_base = OTHER; note = 2'-O-methyladenosine-3'-phosphate
  modified_base 4: mod_base = OTHER; note = 2'-O-methylguanosine-3'-phosphate
  modified_base 6: mod_base = OTHER; note = 2'-O-methylguanosine-3'-phosphate
  modified_base 7: mod_base = OTHER; note = Adenosine-glycol nucleic acid (GNA) S-Isomer
  modified_base 8: mod_base = OTHER; note = 2'-O-methyluridine-3'-phosphate
  modified_base 9: mod_base = OTHER; note = 2'-O-methylcytidine-3'-phosphate
  modified_base 10: mod_base = OTHER; note = 2'-O-methyluridine-3'-phosphate
  modified_base 11: mod_base = OTHER; note = 2'-O-methylcytidine-3'-phosphate
  modified_base 12: mod_base = OTHER; note = 2'-O-methyladenosine-3'-phosphate
  modified_base 13: mod_base = OTHER; note = 2'-O-methyluridine-3'-phosphate
  modified_base 14: mod_base = OTHER; note = 2'-fluorocytidine-3'-phosphate
  modified_base 15: mod_base = OTHER; note = 2'-O-methyladenosine-3'-phosphate
  modified_base 16: mod_base = OTHER; note = 2'-fluorocytidine-3'-phosphate
  modified_base 17: mod_base = OTHER; note = 2'-O-methyluridine-3'-phosphate
  modified_base 18: mod_base = OTHER; note = 2'-O-methylcytidine-3'-phosphate
  modified_base 19: mod_base = OTHER; note = 2'-O-methyladenosine-3'-phosphate
  modified_base 20: mod_base = OTHER; note = 2'-O-methylcytidine-3'-phosphate
  modified_base 21: mod_base = OTHER; note = 2'-O-methyladenosine-3'- phosphorothioate
  modified_base 22: mod_base = OTHER; note = 2'-O-methyluridine-3'-phosphorothioate
  modified_base 23: mod_base = OTHER; note = 2'-O-methyluridine-3'-phosphate
  misc_feature 1..4: note = RNA
  misc_feature 5: note = DNA
  misc_feature 6..23: note = RNA
aaagagatctcatcactcacatt

(The sequence listing continues in the following parts.)

We claim:

1. A double stranded ribonucleic acid (dsRNA) agent for inhibiting expression of complement factor B (CFB) in a cell, or a pharmaceutically acceptable salt thereof,
wherein the dsRNA agent, or a pharmaceutically acceptable salt thereof, comprises a sense strand and an antisense strand forming a double stranded region,
wherein the sense strand comprises a nucleotide sequence which differs by no more than 4 nucleotides from the nucleotide sequence 5'-gsasauuccuGfAfAfuuuuaugacu-3' of SEQ ID NO:1271 and the antisense strand comprises a nucleotide sequence which differs by no more than 4 nucleotides from the nucleotide sequence 5'-asdGsucdAudAaaaudTcAfggaauucscsu-3' of SEQ ID NO:1922,
wherein a, g, c and u are 2'-O-methyl (2'-OMe) A, G, C, and U, respectively; Af and Gf, are 2'-fluoro A and G, respectively; dG is a 2'-deoxyguanosine-3'-phosphate nucleotide; dA is a 2'-deoxyadenosine-3'-phosphate nucleotide; dT is a 2'-deoxythymidine-3'-phosphate nucleotide; and s is a phosphorothioate linkage.

2. The dsRNA agent, or a pharmaceutically acceptable salt thereof, of claim 1, wherein the sense strand comprises a nucleotide sequence which differs by no more than 3 nucleotides from the nucleotide sequence 5'-gsasauuccuGfAfAfuuuuaugacu-3' of SEQ ID NO:1271 and the antisense strand comprises a nucleotide sequence which differs by no more than 3 nucleotides from the nucleotide sequence 5'-asdGsucdAudAaaaudTcAfggaauucscsu-3' of SEQ ID NO:1922.

3. The dsRNA agent, or a pharmaceutically acceptable salt thereof, of claim 1, wherein the sense strand comprises a nucleotide sequence which differs by no more than 2 nucleotides from the nucleotide sequence 5'-gsasauuccuGfAfAfuuuuaugacu-3' of SEQ ID NO:1271 and the antisense strand comprises a nucleotide sequence which differs by no more than 2 nucleotides from the nucleotide sequence 5'-asdGsucdAudAaaaudTcAfggaauucscsu-3' of SEQ ID NO:1922.

4. The dsRNA agent, or a pharmaceutically acceptable salt thereof, of claim 1, wherein the sense strand comprises a nucleotide sequence which differs by no more than 1 nucleotide from the nucleotide sequence 5'-gsasauuccuGfAfAfuuuuaugacu-3' of SEQ ID NO:1271 and the antisense strand comprises a nucleotide sequence which differs by no more than 1 nucleotide from the nucleotide sequence 5'-asdGsucdAudAaaaudTcAfggaauucscsu-3' of SEQ ID NO:1922.

5. The dsRNA agent, or a pharmaceutically acceptable salt thereof, of claim 1, wherein the sense strand comprises the nucleotide sequence 5'-gsasauuccuGfAfAfuuuuaugacu-3' of SEQ ID NO:1271 and the antisense strand comprises the nucleotide sequence 5'-asdGsucdAudAaaaudTcAfggaauucscsu-3' of SEQ ID NO:1922.

6. The dsRNA agent, or a pharmaceutically acceptable salt thereof, of claim 1, wherein the sense strand consists of the nucleotide sequence 5'-gsasauuccuGfAfAfuuuuaugacu-3' of SEQ ID NO:1271 and the antisense strand consists of the nucleotide sequence 5'-asdGsucdAudAaaaudTcAfggaauucscsu-3' of SEQ ID NO:1922.

7. The dsRNA agent, or a pharmaceutically acceptable salt thereof, of any one of claims 1-6, further comprising a ligand.

8. The dsRNA agent, or a pharmaceutically acceptable salt thereof, of claim 7, wherein the ligand is conjugated to the 3' end of the sense strand of the dsRNA agent or a pharmaceutically acceptable salt thereof.

9. The dsRNA agent, or a pharmaceutically acceptable salt thereof, of claim 7, wherein the ligand is an N-acetylgalactosamine (GalNAc) derivative.

10. The dsRNA agent, or a pharmaceutically acceptable salt thereof, of claim 9, wherein the ligand is conjugated to the dsRNA agent, or a pharmaceutically acceptable salt thereof, through a monovalent, bivalent, or trivalent linker.

11. The dsRNA agent, or a pharmaceutically acceptable salt thereof, of claim 9, wherein the ligand is

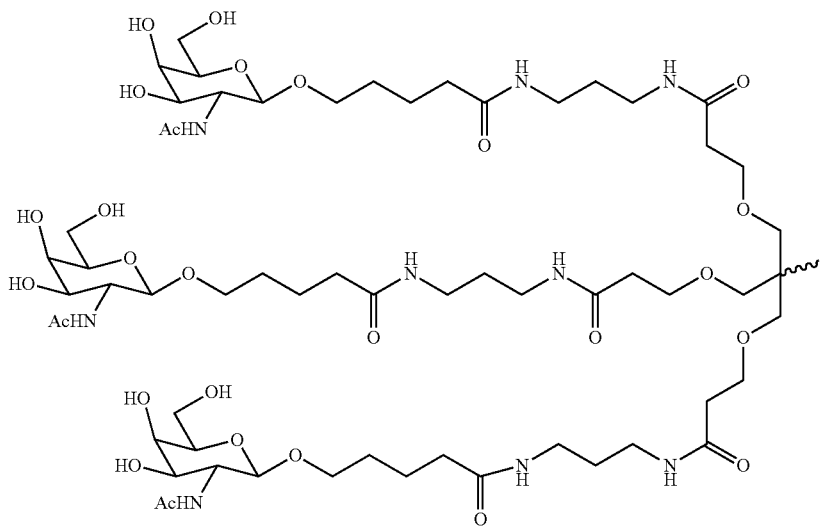

12. The dsRNA agent, or a pharmaceutically acceptable salt thereof, of claim 11, wherein the dsRNA agent, or a pharmaceutically acceptable salt thereof, is conjugated to the ligand as shown in the following schematic

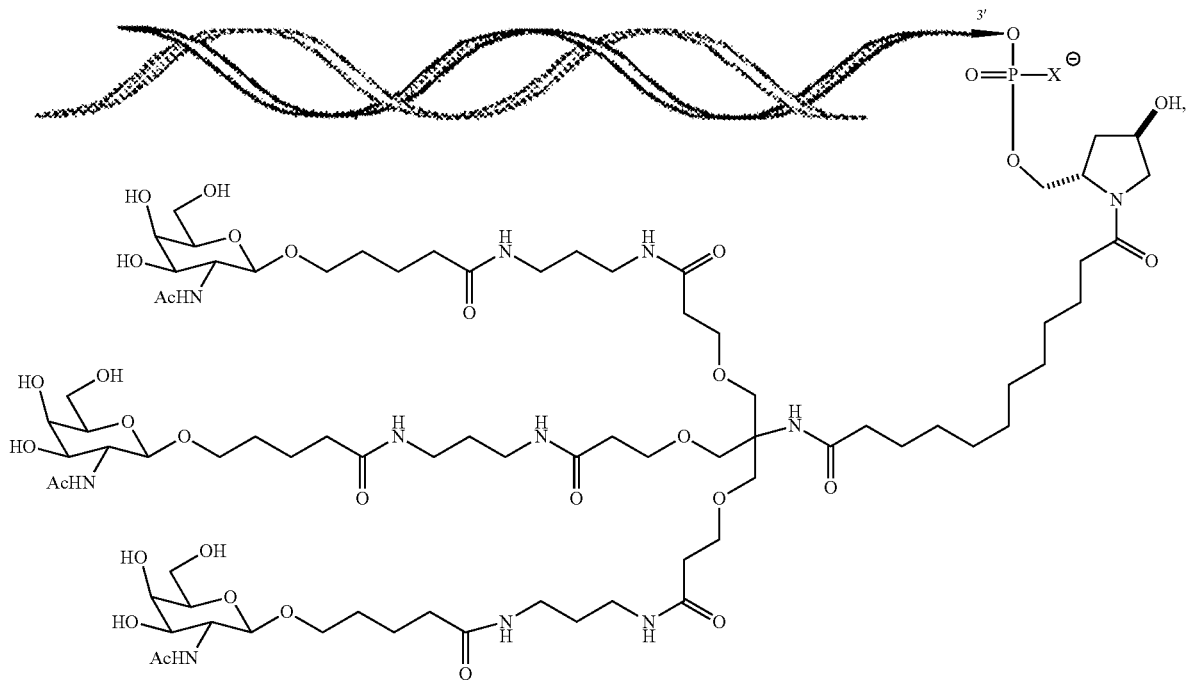

wherein X is O or S.

13. The dsRNA agent, or a pharmaceutically acceptable salt thereof, of claim 12, wherein X is O.

14. An isolated cell containing the dsRNA agent, or a pharmaceutically acceptable salt thereof, of any one of claims 1-6.

15. A pharmaceutical composition comprising the dsRNA agent, or a pharmaceutically acceptable salt thereof, of any one of claims 1-6.

16. The pharmaceutical composition of claim 15, wherein the dsRNA agent, or a pharmaceutically acceptable salt thereof, is in an unbuffered solution.

17. The pharmaceutical composition of claim 16, wherein the unbuffered solution is saline or water.

18. The pharmaceutical composition of claim 15, wherein the dsRNA agent, or a pharmaceutically acceptable salt thereof, is in a buffer solution.

19. The pharmaceutical composition of claim 18, wherein the buffer solution comprises acetate, citrate, prolamine, carbonate, or phosphate or any combination thereof.

20. The pharmaceutical composition of claim 19, wherein the buffer solution is phosphate buffered saline (PBS).

21. A double stranded ribonucleic acid (dsRNA) agent for inhibiting expression of complement factor B (CFB) in a cell, or a pharmaceutically acceptable salt thereof,
wherein the dsRNA agent, or a pharmaceutically acceptable salt thereof, comprises a sense strand and an antisense strand forming a double stranded region,
wherein the sense strand comprises the nucleotide sequence 5'-gsasauuccuGfAfAfuuuuaugacu-3' of SEQ ID NO:1271 and the antisense strand comprises the nucleotide sequence 5'-asdGsucdAudAaaaudTcAfg-gaauucscsu-3' of SEQ ID NO:1922, wherein a, g, c and u are 2'-O-methyl (2'-OMe) A, G, C, and U, respectively; Af and Gf are 2'-fluoro A and G, respectively; dG is a 2'-deoxyguanosine-3'-phosphate nucleotide; dA is a 2'-deoxyadenosine-3'-phosphate nucleotide; dT is a 2'-deoxythymidine-3'-phosphate nucleotide; and s is a phosphorothioate linkage, and wherein the 3'-end of the sense strand is conjugated to a ligand as shown in the following schematic

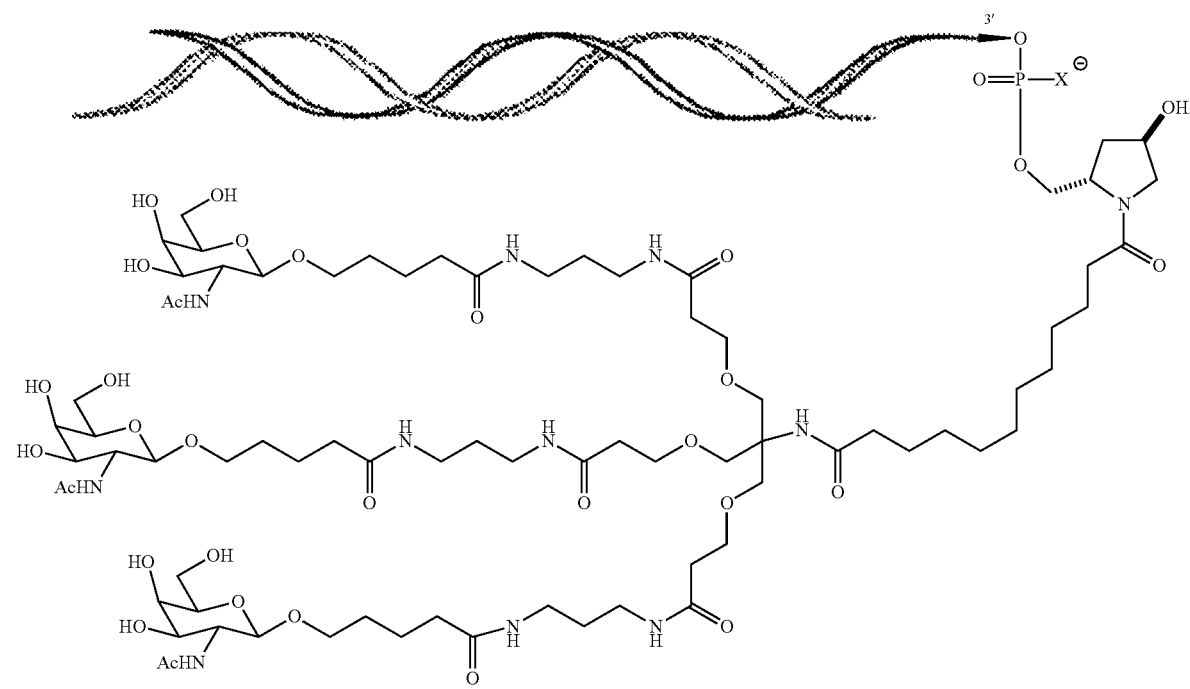

wherein X is O.

22. An isolated cell containing the dsRNA agent, or a pharmaceutically acceptable salt thereof, of claim 21.

23. A pharmaceutical composition comprising the dsRNA agent, or a pharmaceutically acceptable salt thereof, of claim 21.

24. The pharmaceutical composition of claim 23, wherein dsRNA agent, or a pharmaceutically acceptable salt thereof, is in an unbuffered solution.

25. The pharmaceutical composition of claim 23, wherein the dsRNA agent, or a pharmaceutically acceptable salt thereof, is in a buffer solution.

26. A double stranded ribonucleic acid (dsRNA) agent for inhibiting expression of complement factor B (CFB) in a cell, or a pharmaceutically acceptable salt thereof,
wherein the dsRNA, or a pharmaceutically acceptable salt thereof, comprises a sense strand and an antisense strand forming a double stranded region,
wherein the sense strand consists of the nucleotide sequence 5'-gsasauuccuGfAfAfuuuuaugacu-3' of SEQ ID NO:1271 and the antisense strand consists of the nucleotide sequence 5'-asdGsucdAudAaaaudTcAfg-gaauucscsu-3' of SEQ ID NO:1922, wherein a, g, c and u are 2'-O-methyl (2'-OMe) A, G, C, and U, respectively; Af and Gf are 2'-fluoro A and G, respectively; dG is a 2'-deoxyguanosine-3'-phosphate nucleotide; dA is a 2'-deoxyadenosine-3'-phosphate nucleotide; dT is a 2'-deoxythymidine-3'-phosphate nucleotide; and s is a phosphorothioate linkage, and wherein the 3'-end of the sense strand is conjugated to a ligand as shown in the following schematic

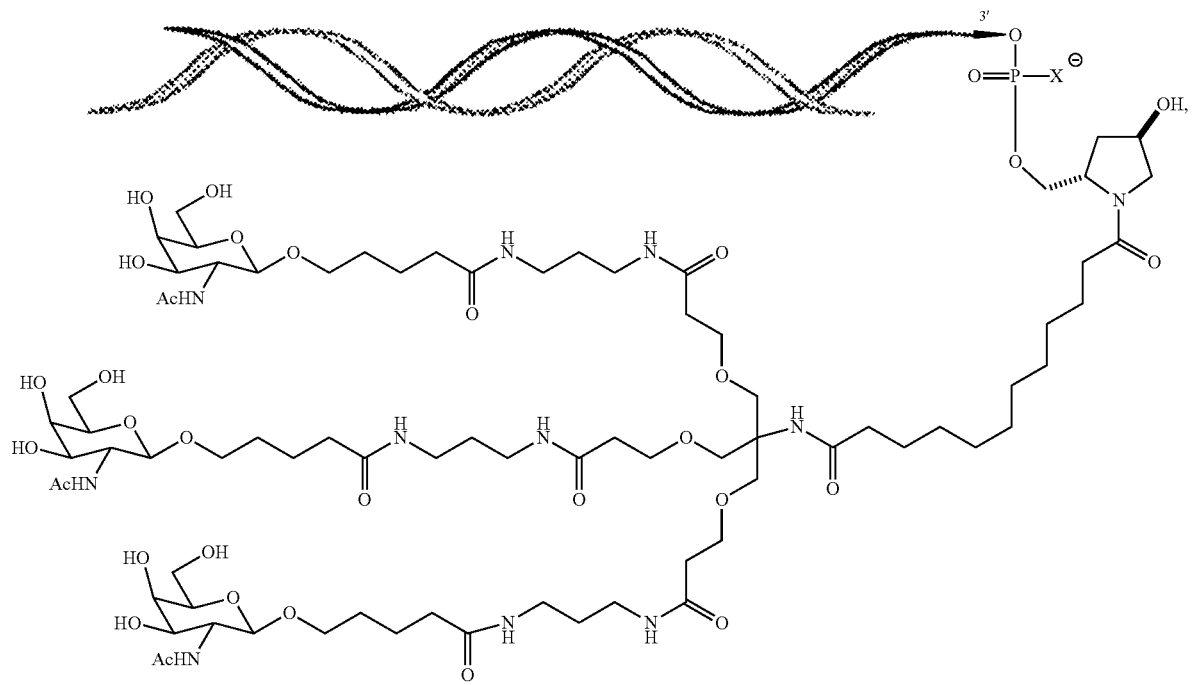

wherein X is O.

27. An isolated cell containing the dsRNA agent, or a pharmaceutically acceptable salt thereof, of claim 26.

28. A pharmaceutical composition comprising the dsRNA agent, or a pharmaceutically acceptable salt thereof, of claim 26.

29. The pharmaceutical composition of claim 28, wherein dsRNA agent, or a pharmaceutically acceptable salt thereof, is in an unbuffered solution.

30. The pharmaceutical composition of claim 28, wherein said dsRNA agent, or a pharmaceutically acceptable salt thereof, is in a buffer solution.

* * * * *